(12) United States Patent
Hoffmann et al.

(10) Patent No.: US 8,778,621 B2
(45) Date of Patent: Jul. 15, 2014

(54) PHOSPHODIESTERASE 4D7 AS MARKER FOR MALIGNANT, HORMONE-SENSITIVE PROSTATE CANCER

(75) Inventors: Ralf Hoffmann, Brueggen (DE); Miles Douglas Houslay, Renfrewshire (GB); David James Peter Henderson, Newton Stewart (GB)

(73) Assignee: Koninklijke Philips N.V., Eindhoven (NL)

( * ) Notice: Subject to any disclaimer, the term of this patent is extended or adjusted under 35 U.S.C. 154(b) by 170 days.

(21) Appl. No.: 13/320,050

(22) PCT Filed: May 11, 2010

(86) PCT No.: PCT/IB2010/052072
§ 371 (c)(1),
(2), (4) Date: Feb. 7, 2012

(87) PCT Pub. No.: WO2010/131194
PCT Pub. Date: Nov. 18, 2010

(65) Prior Publication Data
US 2012/0129788 A1    May 24, 2012

(30) Foreign Application Priority Data

May 12, 2009  (EP) ..................................... 09159960
Sep. 8, 2009  (EP) ..................................... 09169739

(51) Int. Cl.
*G01N 33/574*    (2006.01)

(52) U.S. Cl.
USPC ........................................ 435/7.23; 435/6.14

(58) Field of Classification Search
None
See application file for complete search history.

(56) References Cited

U.S. PATENT DOCUMENTS

| 2002/0193612 A1 | 12/2002 | Chambers |
| 2003/0220273 A1 | 11/2003 | Bennett |
| 2005/0095634 A1* | 5/2005 | Baker et al. ........................ 435/6 |
| 2011/0136115 A1* | 6/2011 | Sledziewski et al. ........ 435/6.11 |

FOREIGN PATENT DOCUMENTS

| WO | 03044170 A1 | 5/2003 |
| WO | 2004042389 A2 | 5/2004 |
| WO | 2007134451 A2 | 11/2007 |
| WO | 2008009479 A1 | 1/2008 |

OTHER PUBLICATIONS

Tockman et al, Cancer Res., 1992, 52:2711s-2718s.*
Slamon et al, Science vol. 235, Jan. 1987, pp. 177-182.*
Rahrmann et al, Cancer Res, epub Apr. 28, 2009, 69:4388-4397.*
Mikolajczyk et al, Clin. Biochem. (2004) 37 p. 519-528.*
"Cyclic AMP Phoshodiesterase 4d7 Isoforms and Methods of Use" Database JPO Proteins (Online), Apr. 26, 2006, JPOP:BD869710; XP-00253725.
Zhang, Lingzhi et al "Cyclic Nucleotide Phosphodiesterase Profiling Reveals Increased Expression of Phosphodiesterase 7B in Chronic Lymphocytic Leukemia" Proceedings of the National Academy of Sciences of the United States of America, vol. 105, No. 49, Dec. 2008, pp. 19532-19537.
Merz, K.H. et al "Synthesis of 7-Benzylamino-6-Chloro-2-Piperzino-4-PYRR Olidinopterid INE and Novel Derivatives Free of Positional Isomers. Potent Inhibitors of Camp-Specific Phosphodiesterase and of Malignant Tumor Cell Growth" Journal of Medicinal Chemistry, American Chemical Society, Washington, vol. 41, No. 24, Jan. 1, 1998, pp. 4733-4743.

* cited by examiner

*Primary Examiner* — Mark Halvorson

(57) ABSTRACT

The present invention relates to phosphodiesterase 4D7 (PDE4D7) for use as a marker for malignant, hormone-sensitive prostate cancer, wherein the expression of the marker is increased when comparing the expression in malignant, hormone-sensitive prostate cancer tissue, to the expression in normal tissue or benign prostate tumor tissue, and the use of PDE4D7 as a diagnostic marker for malignant, hormone-sensitive prostate cancer. The present invention also relates to a composition for diagnosing, detecting, monitoring or prognosticating malignant, hormone-sensitive prostate cancer, a corresponding detection method, a method allowing to discriminate between a benign and malignant hormone-sensitive prostate cancer and a method of data acquisition, as well as corresponding immunoassays. The present invention also relates to a method of identifying an individual for eligibility for malignant, hormone-sensitive prostate cancer as well as an immunoassay for stratifying an individual with such prostate cancer. The present invention further envisages pharmaceutical compositions and their use for the treatment of malignant, hormone-sensitive prostate cancer.

9 Claims, 18 Drawing Sheets

FIGURE 1 A

| age | gender | tissue | appearance | diagnosis | tumorgrade | tnm | stage | verification |
|---|---|---|---|---|---|---|---|---|
| 67 | Male | Prostate / Prostate | Normal | Adenocarcinoma of prostate | Gleason Score: 3+4=7/10 | pT2cpN0pMX | II | Within normal limits |
| 68 | Male | Prostate / Prostate | Normal | Adenocarcinoma of prostate | Gleason Score: 4+3=7/10 | pT3apN0pMX | III | Within normal limits |
| 53 | Male | Prostate / Prostate | Normal | Adenocarcinoma of prostate | Gleason Score: 3+3=6/10 | pT2bpN0pMX | II | Within normal limits |
| 65 | Male | Prostate / Prostate | Normal | Adenocarcinoma of prostate | Gleason Score: 3+3=6/10 | pT2apN0pMX | II | Within normal limits |
| 48 | Male | Prostate / Prostate | Normal | Adenocarcinoma of prostate | Gleason Score: 3+3=6/10 | pT2apNXpMX | II | Within normal limits |
| 68 | Male | Prostate / Prostate | Normal | Adenocarcinoma of prostate | Gleason Score: 3+3=6/10 | pT2apNXpMX | II | Within normal limits |
| 76 | Male | Prostate / Prostate | Normal | Adenocarcinoma of prostate | Gleason Score: 4+3=7/10 | pT3apN0pMX | III | Within normal limits |
| 60 | Male | Prostate / Prostate | Lesion | Adenocarcinoma of prostate | Gleason Score: 3+3=6/10 | pT1apN0pMX | I | Hyperplasia of prostate |
| 70 | Male | Prostate / Prostate | Lesion | Carcinoma of bladder, transitional cell | AJCC G3: Poorly differentiated | pT1pN0pMX | I | Hyperplasia of prostate |
| 74 | Male | Prostate / Prostate | Lesion | Adenocarcinoma of prostate | Gleason Score: 3+3=6/10 | pT2cpN0pMX | II | Hyperplasia of prostate |
| 66 | Male | Prostate / Prostate | Lesion | Adenocarcinoma of prostate | Gleason Score: 4+3=7/10 | pT2pNXpMX | II | Prostatitis, chronic |
| 72 | Male | Prostate / Prostate | Lesion | Adenocarcinoma of prostate | Gleason Score: 3+4=7/10 | pT2apN0pMX | II | Hyperplasia of prostate |
| 63 | Male | Prostate / Prostate | Lesion | Adenocarcinoma of prostate | Gleason Score: 3+4=7/10 | pT2cpNXpMX | II | Prostatitis |
| 55 | Male | Prostate / Prostate | Lesion | Adenocarcinoma of prostate | Gleason Score: 3+4=7/10 | pT2cpN0pMX | II | Hyperplasia of prostate |
| 70 | Male | Prostate / Prostate | Lesion | Adenocarcinoma of prostate | Gleason Score: 3+4=7/10 | pT2cpN0pMX | II | Hyperplasia of prostate |
| 68 | Male | Prostate / Prostate | Lesion | Adenocarcinoma of prostate | Gleason Score: 3+3=6/10 | pT2cpN0pMX | II | Hyperplasia of prostate |
| 66 | Male | Prostate / Prostate | Lesion | Adenocarcinoma of prostate | Gleason Score: 2+2=4/10 | pT2apNXpMX | II | Prostatitis, acute |
| 76 | Male | Prostate / Prostate | Lesion | Adenocarcinoma of prostate | Not Reported | pT2cpN0pMX | II | Hyperplasia of prostate |
| 71 | Male | Prostate / Prostate | Lesion | Adenocarcinoma of prostate | Gleason Score: 3+4=7/10 | pT2cpN0pMX | II | Hyperplasia of prostate |
| 56 | Male | Prostate / Prostate | Lesion | Adenocarcinoma of prostate | Gleason Score: 3+4=7/10 | pT2bpNXpMX | II | Hyperplasia of prostate |
| 61 | Male | Prostate / Prostate | Lesion | Adenocarcinoma of prostate | Gleason Score: 4+3=7/10 | pT2cpN0pMX | II | Hyperplasia of prostate |
| 63 | Male | Prostate / Prostate | Tumor | Adenocarcinoma of prostate | Gleason Score: 3+4=7/10 | pT2cpNXpMX | II | Adenocarcinoma of prostate |
| 70 | Male | Prostate / Prostate | Tumor | Adenocarcinoma of prostate | Gleason Score: 3+3=5/10 | pT2cpNXpMX | II | Adenocarcinoma of prostate |
| 68 | Male | Prostate / Prostate | Tumor | Adenocarcinoma of prostate | Gleason Score: 3+3=6/10 | pT2cpN0pMX | II | Adenocarcinoma of prostate |
| 61 | Male | Prostate / Prostate | Tumor | Adenocarcinoma of prostate | Gleason Score: 3+3=5/10 | pT2cpNXpMX | II | Adenocarcinoma of prostate |
| 59 | Male | Prostate / Prostate | Tumor | Adenocarcinoma of prostate | Gleason Score: 4+5=9/10 | pT2cpN0pMX | II | Adenocarcinoma of prostate |
| 61 | Male | Prostate / Prostate | Tumor | Adenocarcinoma of prostate | Gleason Score: 3+4=7/10 | pT2bpN0pMX | II | Adenocarcinoma of prostate |

FIGURE 1B

| Age | Sex | Tissue | Type | Diagnosis | Gleason Score | TNM | Stage | Additional |
|---|---|---|---|---|---|---|---|---|
| 63 | Male | Prostate / Prostate | Tumor | Adenocarcinoma of prostate | Gleason Score: 3+4=7/10 | pT2cpNXpMX | II | Adenocarcinoma of prostate |
| 53 | Male | Prostate / Prostate | Lesion | Adenocarcinoma of prostate | Gleason Score: 4+3=7/10 | pT3apN0pMX | III | Hyperplasia of prostate, nodular |
| 66 | Male | Prostate / Prostate | Lesion | Adenocarcinoma of prostate | Gleason Score: 3+5=8/10 | pT3bpNXpMX | III | Hyperplasia of prostate |
| 61 | Male | Prostate / Prostate | Lesion | Adenocarcinoma of prostate | Gleason Score: 4+3=7/10 | pT3bpNXpMX | III | Hyperplasia of prostate |
| 65 | Male | Prostate / Prostate | Lesion | Adenocarcinoma of prostate | Gleason Score: 4+4=8/10 | pT3bpN0pMX | III | Prostatitis, chronic |
| 64 | Male | Prostate / Prostate | Lesion | Adenocarcinoma of prostate | Gleason Score: 3+4=7/10 | pT3apNXpMX | III | Hyperplasia of prostate |
| 46 | Male | Prostate / Prostate | Tumor | Adenocarcinoma of prostate | Gleason Score: 4+5=9/10 | pT3bpN0pMX | III | Adenocarcinoma of prostate |
| 65 | Male | Prostate / Prostate | Tumor | Adenocarcinoma of prostate | Gleason Score: 4+4=8/10 | pT3apN0pMX | III | Adenocarcinoma of prostate |
| 61 | Male | Prostate / Prostate | Tumor | Adenocarcinoma of prostate | Gleason Score: 4+4=8/10 | pT3apN1pMX | III | Adenocarcinoma of prostate |
| 51 | Male | Prostate / Prostate | Lesion | Carcinoma of bladder, urothelial | AJCC G4: Undifferentiated | pT4pN0pMX | IV | Hyperplasia of prostate |
| 76 | Male | Prostate / Prostate | Lesion | Adenomatous hyperplasia of prostate, atypical | | Not Reported | BHP | Hyperplasia of prostate |
| 62 | Male | Prostate / Prostate | Lesion | Hyperplasia of prostate | | Not Reported | BHP | Hyperplasia of prostate |
| 72 | Male | Prostate / Prostate | Lesion | Hyperplasia of prostate | | Not Reported | BHP | Hyperplasia of prostate |
| 71 | Male | Prostate / Prostate | Lesion | Hyperplasia of prostate | | Not Reported | BHP | Hyperplasia of prostate |
| 76 | Male | Prostate / Prostate | Lesion | Glandular hyperplasia of prostate | | Not Reported | BHP | Glandular hyperplasia of prostate |
| 71 | Male | Prostate / Prostate | Lesion | Hyperplasia of prostate | | Not Reported | BHP | Hyperplasia of prostate |
| 76 | Male | Prostate / Prostate | Lesion | Hyperplasia of prostate | | Not Reported | BHP | Hyperplasia of prostate |
| 76 | Male | Prostate / Prostate | Lesion | Hyperplasia of prostate | | Not Reported | BHP | Hyperplasia of prostate |
| 56 | Male | Prostate / Prostate | Lesion | Hyperplasia of prostate | | Not Reported | BHP | Hyperplasia of prostate |
| 85 | Male | Prostate / Prostate | Lesion | Adenoma of prostate | | Not Reported | BHP | Hyperplasia of prostate |
| 72 | Male | Prostate / Prostate | Lesion | Hyperplasia of prostate | | Not Reported | BHP | Hyperplasia of prostate |

PHOSPHODIESTERASE 4D7 AS MARKER FOR MALIGNANT, HORMONE-SENSITIVE PROSTATE CANCER

FIELD OF THE INVENTION

The present invention relates to phosphodiesterase 4D7 (PDE4D7) for use as a marker for malignant, hormone-sensitive prostate cancer, wherein the expression of the marker is increased when comparing the expression in malignant, hormone-sensitive prostate cancer tissue, to the expression in normal tissue or benign prostate tumor tissue, and the use of PDE4D7 as a diagnostic marker for malignant, hormone-sensitive prostate cancer. The present invention also relates to a composition for diagnosing, detecting, monitoring or prognosticating malignant, hormone-sensitive prostate cancer, a corresponding detection method, a method allowing to discriminate between a benign and malignant hormone-sensitive prostate cancer and a method of data acquisition, as well as corresponding immunoassays. The present invention also relates to a method of identifying an individual for eligibility for malignant, hormone-sensitive prostate cancer as well as an immunoassay for stratifying an individual with such prostate cancer. The present invention further envisages pharmaceutical compositions and their use for the treatment of malignant, hormone-sensitive prostate cancer. The present invention also relates to the use of an antibody specific for the PDE4D7 protein for detecting, diagnosing, monitoring or prognosticating cancer or for the treatment of cancer.

BACKGROUND OF THE INVENTION

Cancer is a class of diseases in which a group of cells display uncontrolled growth, invasion and sometimes metastasis. These three malignant properties of cancers differentiate them from benign tumors, which are self-limited, do not invade or metastasize. Among men, the three most commonly diagnosed cancers are prostate, lung and colorectal cancer in developed countries. Particularly prostate cancer is the most common malignancy in European males. In 2002 in Europe, an estimated 225,000 men were newly diagnosed with prostate cancer and about 83,000 died from this disease.

Certain phosphodiesterases have been associated with cancer development. For instance, phosphodiesterase PDE7 has been shown to be linked to chronic lymphocytic leukemia. Yet, for many cancer types or cancer progression forms there is no adequate marker molecule available.

Prostate cancer, for example, is traditionally diagnosed via the serum level of prostate-specific antigen (PSA). However, PSA is not prostate cancer-specific and can be raised in other circumstances, leading to a large number of false-positives (cancer is not found in around 70% of men with raised PSA levels who undergo biopsy). Furthermore, there will be an unpredictable number of false-negatives who later develop prostate cancer in the presence of a "normal" PSA test.

Therefore, there is a need for the provision of a new and effective, alternative diagnosis perspective for the detection, monitoring and prognostication of prostate cancer, in particular of malignant, hormone-sensitive prostate cancer.

SUMMARY OF THE INVENTION

The present invention addresses this need and provides means and methods which allow the diagnosis and detection of prostate cancer, in particular malignant, hormone-sensitive prostate cancer. The above objective is accomplished by phosphodiesterase 4D7 (PDE4D7) for use as a marker for malignant, hormone-sensitive prostate cancer, wherein the expression of the marker is increased when comparing the expression in malignant, hormone-sensitive prostate cancer tissue, to the expression in normal tissue or benign prostate tumor tissue.

Phosphodiesterase 4D7 is shown by the present inventors to be up-regulated in prostate cancer cells or cell lines. PDE4D7 is, thus, considered as a biomarker for prostate cancer prediction and a decision tool for the stratification of prostate cancer surveillance regimes, as well as the prognosis and monitoring of prostate cancer progression. In particular, it was demonstrated by the present inventors that PDE4D7 is up-regulated in particular in human-derived malignant, hormone-sensitive prostate cancer cells or cell lines as well as corresponding human tissue samples. Diagnostic methods and uses based on PDE4D7 as a prostate cancer marker can, thus, advantageously be employed for (i) detecting and diagnosing malignant, hormone-sensitive prostate cancer, (ii) prognosticating malignant, hormone-sensitive prostate cancer, (iii) monitoring of cancer progression towards malignant, hormone-sensitive prostate cancer forms, and (iv) distinguishing between benign and malignant, hormone-sensitive prostate cancer forms.

In another aspect the present invention relates to a composition for diagnosing, detecting, monitoring or prognosticating malignant, hormone-sensitive prostate cancer or the progression towards malignant, hormone-sensitive prostate cancer, comprising a nucleic acid affinity ligand and/or a peptide affinity ligand for the PDE4D7 expression product or protein.

In a preferred embodiment of the present invention said composition comprises a nucleic acid affinity ligand or peptide affinity ligand which is modified to function as a contrast agent.

In a further preferred embodiment of the present invention said composition comprises a set of oligonucleotides specific for the PDE4D7 expression product, a probe specific for the PDE4D7 expression product, an aptamer specific for the PDE4D7 expression product or protein, an antibody specific for the PDE4D7 protein and/or an antibody variant specific for the PDE4D7 protein.

In a further aspect the present invention relates to the use of PDE4D7 as a marker for diagnosing, detecting, monitoring or prognosticating malignant, hormone-sensitive prostate cancer or the progression towards malignant, hormone-sensitive prostate cancer.

In another aspect the present invention relates to a method for detecting, diagnosing, monitoring or prognosticating malignant, hormone-sensitive prostate cancer or the progression towards malignant, hormone-sensitive prostate cancer comprising at least the step of determining the level of PDE4D7 in a sample.

In another aspect the present invention relates to a method for diagnosing, monitoring or prognosticating malignant, hormone-sensitive prostate cancer or the progression towards malignant, hormone-sensitive prostate cancer, wherein said method discriminates between a benign prostate tumor and a malignant, hormone-sensitive prostate cancer, comprising the steps of (a) determining the level of PDE4D7 in a sample;
(b) determining the level of expression of reference gene in a sample;
(c) normalizing the measured expression level of PDE4D7 to the expression of the expression of the reference gene; and
(d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 and +2, preferably about 0.

In another aspect the present invention relates to a method of data acquisition comprising at least the steps of:
 (a) testing in an individual for expression of PDE4D7; and
 (b) comparing the expression as determined in step (a) to a control level.

In a further preferred embodiment of the present invention the diagnosing, detecting, monitoring prognosticating or data acquisition is to be carried out on a sample obtained from an individual.

In another aspect the present invention relates to an immunoassay for detecting, diagnosing, monitoring or prognosticating malignant, hormone-sensitive prostate cancer or the progression towards malignant, hormone-sensitive prostate cancer comprising at least the steps
 (a) testing in a sample obtained from an individual for the expression of PDE4D7,
 (b) testing in a control sample for the expression of PDE4D7,
 (c) determining the difference in expression of PDE4D7 of steps (a) and (b); and
 (d) deciding on the presence or stage of cancer or the progression of cancer based on the results obtained in step (c), wherein said testing steps are based on the use of an antibody specifically binding to PDE4D7.

In another aspect the present invention relates to an immunoassay for discriminating between a benign prostate tumor and a malignant, hormone-sensitive prostate cancer, comprising the steps of:
 (a) determining the level of PDE4D7 in a sample;
 (b) determining the level of expression of a reference gene in a sample;
 (c) normalizing the measured expression level of PDE4D7 to the expression of the reference gene; and
 (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 and +2, preferably about 0.

In another aspect the present invention relates to a method of identifying an individual for eligibility for malignant, hormone-sensitive cancer therapy comprising:
 (a) testing in a sample obtained from an individual for the expression of PDE4D7;
 (b) testing in said sample for the expression of a reference gene and/or testing in a control sample for the expression of PDE4D7;
 (c) classifying the levels of expression of step (a) relative to levels in control samples of PDE4D7 of step (b); and
 (d) identifying the individual as eligible to receive a malignant, hormone-sensitive prostate cancer therapy where the individual's sample is classified as having an increased level of PDE4D7 expression.

In yet another aspect the present invention relates to an immunoassay for stratifying an individual or cohort of individuals with a malignant, hormone-sensitive prostate cancer disease comprising:
 (a) testing in a sample obtained from an individual for the expression of PDE4D7;
 (b) testing in said sample for the expression of a reference gene and/or testing in a control sample for the expression of PDE4D7;
 (c) determining the difference in expression of PDE4D7 of step (a) and the expression of PDE4D7 and/or the reference gene in step (b); and
 (d) stratifying an individual or cohort of individuals to malignant, hormone-sensitive prostate cancer therapy based on the results obtained in step (c), where the individual's sample has an increased level of PDE4D7 expression.

In a further preferred embodiment of the present invention said testing or determining of the expression is accomplished, or additionally accomplished, by the measurement of nucleic acid or protein levels or by the determination of the biological activity of PDE4D7, or of the reference gene.

In a further preferred embodiment of the present invention said method or immunoassay comprises the additional step of comparing the measured nucleic acid or protein levels or the measured biological activity to a control level.

In a further preferred embodiment of the present invention said reference gene is a housekeeping gene, particularly preferred GAPDH or PBGD, or a different phosphodiesterase, particularly preferred PDE4D5.

In a preferred embodiment of the present invention said determining step is accomplished by the measurement of nucleic acid or protein levels or by the determination of the biological activity of PDE4D7.

In a further preferred embodiment of the present invention said method comprises the additional step of comparing the measured nucleic acid or protein levels or the measured biological activity to a control level.

In a further preferred embodiment of the present invention said method or immunoassay comprises the additional step of determining the level of prostate specific antigen (PSA).

In a further, particularly preferred embodiment of the present invention a PSA level of 2.5 to 4 ng/ml determined in an additional step of a method or immunoassay as defined above is indicative of a malignant, hormone-sensitive prostate cancer.

In a further preferred embodiment of the present invention the sample as mentioned above is a tissue sample, a urine sample, a biopsy sample, a urine sediment sample, a blood sample, a saliva sample, a semen sample, a sample comprising circulating tumor cells or a sample containing prostate secreted exosomes.

In yet another aspect the present invention relates to an inhibitory pharmaceutical composition comprising at least one element selected from the group of:
 (a) a compound directly inhibiting the activity of PDE4D7, preferably an antagonist of PDE4D7 enzymatic activity;
 (b) a compound indirectly inhibiting the activity of PDE4D7;
 (c) a dominant negative form of the PDE4D7 protein or a biologically active equivalent thereof;
 (d) a nucleic acid encoding and expressing a dominant negative form of PDE4D7;
 (e) a miRNA specific for PDE4D7;
 (f) a PDE4D7 antisense molecule;
 (g) a siRNA specific for PDE4D7;
 (h) an aptamer specific for the PDE4D7 expression product or for the PDE4D7 protein;
 (i) a small molecule or peptidomimetic capable of specifically binding to the PDE4D7 protein; and
 (j) an antibody specific for the PDE4D7 protein and/or an antibody variant specific for the PDE4D7 protein.

In yet another aspect the present invention relates to an inhibitory pharmaceutical composition for the treatment or prevention of malignant, hormone-sensitive prostate cancer comprising at least one element selected from the group of:

(a) a compound directly inhibiting the activity of PDE4D7, preferably an antagonist of PDE4D7 enzymatic activity;

(b) a compound indirectly inhibiting the activity of PDE4D7;

(c) a dominant negative form of the PDE4D7 protein or a biologically active equivalent thereof;

(d) a nucleic acid encoding and expressing a dominant negative form of PDE4D7;

(e) a miRNA specific for PDE4D7;

(f) a PDE4D7 antisense molecule;

(g) a siRNA specific for PDE4D7;

(h) an aptamer specific for the PDE4D7 expression product or for the PDE4D7 protein;

(i) a small molecule or peptidomimetic capable of specifically binding to the PDE4D7 protein; and (j) an antibody specific for the PDE4D7 protein and/or an antibody variant specific for the PDE4D7 protein.

As phosphodiestrase 4D7 is up-regulated in the context of malignant, hormone-sensitive prostate cancer, PDE4D7 inhibitors and agents modifying, e.g. inhibiting PDE4D7, modifying PDE4D7 expression, e.g. inhibiting PDE4D7, expression or modifying PDE4D7 interactions, e.g. inhibiting PDE4D7 interactions, can advantageously be used as medicaments. Thus, by counteracting the observed up-regulation process, PDE4D7 inhibitors and/or modification agents may be used as a medicament, e.g. as a medicament counteracting all or some of the effects associated with a high PDE4D7 expression or its up-regulation.

In another aspect the present invention relates to a stimulatory pharmaceutical composition comprising at least one element selected from the group of:

(a) a compound directly stimulating or modulating the activity of PDE4D7, preferably an allosteric agonist of PDE4D7 enzymatic activity;

(b) a compound indirectly stimulating or modulating the activity of PDE4D7;

(c) the PDE4D7 protein or a biologically active equivalent thereof;

(d) a nucleic acid encoding and expressing PDE4D7;

(e) a miRNA inhibitor specific for PDE4D7 miRNAs;

(f) a demethylation agent; and (g) a phosphodiesterase displacement factor.

In a preferred embodiment of the present invention either said inhibitory or said stimulatory pharmaceutical composition said is to be used for the treatment of prostate cancer in dependence of the expression level of PDE4D7, wherein said level of expression is determined and/or monitored according to the steps of (a) determining the level of PDE4D7 in a sample;

(b) determining the level of expression of a reference gene in a sample; and (c) normalizing the measured expression level of PDE4D7 to the expression of the reference gene In a further, particularly preferred embodiment of the present invention for increased and/or increasing levels of PDE4D7 said inhibitory pharmaceutical composition is to be administered, and for decreased and/or decreasing levels of PDE4D7 said stimulatory pharmaceutical composition is to be administered.

In another aspect the present invention relates to the use of an antibody specific for the PDE4D7 protein and/or an antibody variant specific for the PDE4D7 protein for detecting, diagnosing, monitoring or prognosticating cancer or for the treatment of cancer, preferably prostate cancer, more preferably malignant, hormone-sensitive prostate cancer.

In another preferred embodiment of the present invention said cancer as mentioned above is prostate cancer.

In another preferred embodiment of the present invention said prostate cancer is malignant, hormone-sensitive prostate cancer.

In a particularly preferred embodiment of the present invention the malignant, hormone-sensitive prostate cancer is a hormone-sensitive stage I-IV prostate cancer, a hormone-sensitive recurrent prostate cancer, or a hormone-sensitive metastatic prostate cancer.

These and other characteristics, features and objectives of the present invention will become apparent from the following detailed description, taken in conjunction with the accompanying figures and examples, which demonstrate by way of illustration the principles of the invention.

The description is given for the sake of example only, without limiting the scope of the invention.

BRIEF DESCRIPTION OF THE DRAWINGS

FIG. 1 gives in FIGS. 1A and 1B (continuation of FIG. 1A) an overview over the human tissue samples studies by RT-PCR for relative expression of PDE4D7 against GAPDH. Indicated are the age and gender of the patient providing the sample, the tissue type, the appearance of the sample, the diagnosis, the tumor grade (Gleason score), the stage according to the TNM staging system (as as defined by the UICC), the stage of the tumor and a corresponding histological verification which is independent of the marker use.

FIG. 11A shows Normal (N) versus Tumor tissue. FIG. 11B shows Benign (Lesion+Hyperplasia (B)) vs. Tumor tissue. FIG. 11C shows Lesion (L) vs. Tumor tissue. FIG. 11D shows Hyperplasia (H) vs. Tumor tissue. FIG. 11E shows Normal+Benign (NB) versus Tumor tissue.

FIG. 14A shows Normal (N) versus Tumor. FIG. 14B shows Benign (Lesion+Hyperplasia (B)) vs. Tumor. FIG. 14C shows Lesion (L) vs. Tumor. FIG. 14D shows Hyperplasia (H) vs. Tumor. FIG. 14E shows Normal+Benign (NB) versus Tumor.

FIG. 17A shows Normal (N) versus Tumor. FIG. 17B shows Benign (Lesion+Hyperplasia(B)) vs. Tumor. FIG. 17C shows Lesion (L) vs. Tumor. FIG. 17D shows Hyperplasia (H) vs. Tumor. FIG. 17E shows Normal+Benign (NB) versus Tumor.

DETAILED DESCRIPTION OF EMBODIMENTS

Figure 2:
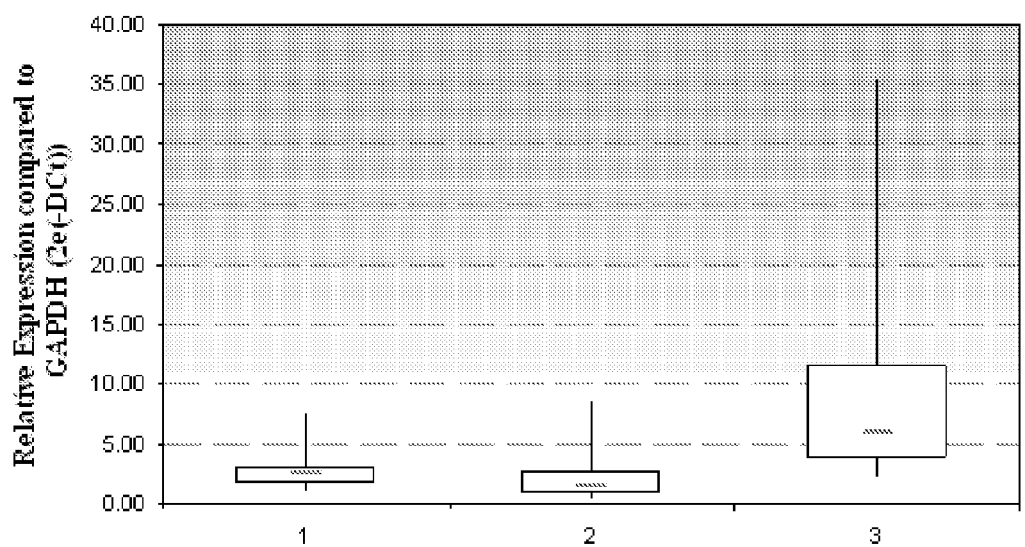
FIG. 2 depicts a Box Plot of relative expression levels of PDE4D7 against GAPDH of normal, benign and malignant prostate tissue samples. In column 1 relative expression levels of PDE4D7 against GAPDH in normal/control tissue samples is shown, in column 2 relative expression levels of PDE4D7 against GAPDH in benign tissue samples are shown and in column 3 relative expression levels of PDE4D7 against GAPDH malignant tissue samples are indicated.

The inventors have found that PDE4D7 is strongly upregulated in certain prostate cancer cells or cell lines and can, hence, be used as biomarker for malignant, hormone-sensitive prostate cancer. PDE4D7 inhibitors as well as agents modifying PDE4D7 or modifying PDE4D7 expression can further be used as medicaments, in particular for the treatment of malignant, hormone-sensitive prostate cancer.

Although the present invention will be described with respect to particular embodiments, this description is not to be construed in a limiting sense.

Before describing in detail exemplary embodiments of the present invention, definitions important for understanding the present invention are given.

As used in this specification and in the appended claims, the singular forms of "a" and "an" also include the respective plurals unless the context clearly dictates otherwise.

In the context of the present invention, the terms "about" and "approximately" denote an interval of accuracy that a person skilled in the art will understand to still ensure the technical effect of the feature in question. The term typically indicates a deviation from the indicated numerical value of ±20%, preferably ±15%, more preferably ±10%, and even more preferably ±5%.

It is to be understood that the term "comprising" is not limiting. For the purposes of the present invention the term "consisting of" is considered to be a preferred embodiment of the term "comprising of". If hereinafter a group is defined to comprise at least a certain number of embodiments, this is meant to also encompass a group which preferably consists of these embodiments only.

Furthermore, the terms "first", "second", "third" or "(a)", "(b)", "(c)", "(d)" etc. and the like in the description and in the claims, are used for distinguishing between similar elements and not necessarily for describing a sequential or chronological order. It is to be understood that the terms so used are interchangeable under appropriate circumstances and that the embodiments of the invention described herein are capable of operation in other sequences than described or illustrated herein.

In case the terms "first", "second", "third" or "(a)", "(b)", "(c)", "(d)" etc. relate to steps of a method or use there is no time or time interval coherence between the steps, i.e. the steps may be carried out simultaneously or there may be time intervals of seconds, minutes, hours, days, weeks, months or even years between such steps, unless otherwise indicated in the application as set forth herein above or below.

It is to be understood that this invention is not limited to the particular methodology, protocols, proteins, bacteria, vectors, reagents etc. described herein as these may vary. It is also to be understood that the terminology used herein is for the purpose of describing particular embodiments only, and is not intended to limit the scope of the present invention that will be limited only by the appended claims. Unless defined otherwise, all technical and scientific terms used herein have the same meanings as commonly understood by one of ordinary skill in the art.

As has been set out above, the present invention concerns in one aspect phosphodiesterase 4D7 (PDE4D7) for use as a marker for malignant, hormone-sensitive prostate cancer, wherein the expression of the marker is increased when comparing the expression in malignant, hormone-sensitive prostate cancer tissue, to the expression in normal tissue or benign prostate tumor tissue. The term "phosphodiesterase 4D7" or "PDE4D7" relates to the splice variant 7 of the human phosphodiesterase PDE4D, i.e. the human phosphodiesterase PDE4D7 gene, preferably to the sequence as defined in Genbank Accession No: AF536976 (version AF536976.1, GI:22901883 as of 3 Mar. 2009), more preferably to the nucleotide sequence as set forth in SEQ ID NO: 1, which corresponds to the sequence of the above indicated Genbank Accession number of the PDE4D7 transcript, and also relates to the corresponding amino acid sequence as set forth in SEQ ID NO: 2, which corresponds to the sequence of the above indicated Genbank Accession number of the PDE4D7 polypeptide encoded by the PDE4D7 transcript. The term also comprises nucleotide sequences showing a high degree of homology to PDE4D7, e.g. nucleic acid sequences being at least 75%, 80%, 85%, 90%, 91%, 92%, 93%, 94%, 95%, 96%, 97%, 98% or 99% identical to the sequence as set forth in SEQ ID NO: 1, or amino acid sequences being at least 75%, 80%, 85%, 90%, 91%, 92%, 93%, 94%, 95%, 96%, 97%, 98% or 99% identical to the sequence as set forth in SEQ ID NO: 2, or nucleic acid sequences encoding amino acid sequences being at least 75%, 80%, 85%, 90%, 91%, 92%, 93%, 94%, 95%, 96%, 97%, 98% or 99% identical to the sequence as set forth in SEQ ID NO: 2, or amino acid sequences being encoded by nucleic acid sequences being at least 75%, 80%, 85%, 90%, 91%, 92%, 93%, 94%, 95%, 96%, 97%, 98% or 99% identical to the sequence as set forth in SEQ ID NO: 1.

The term "human phosphodiesterase PDE4D7 gene", "PDE4D7 gene" or "PDE4D7 marker gene" as used herein relates to the gene encoding phosphodiesterase 4D. Preferably, the term relates to a gene expressing phosphodiesterase 4D as splice variant 7, e.g. the specific exon combination as defined in Genbank Accession No: AF536976 (version AF536976.1, GI:22901883 as of 3 Mar. 2009) or as set forth in SEQ ID NO: 1. The term also relates to DNA molecules derived from mRNA transcripts encoding phosphodiesterase 4D spliced as variant 7, preferably cDNA molecules.

The term "marker" or "PDE4D7 marker", as used herein, relates to a gene, genetic unit or sequence (a nucleotide sequence or amino acid or protein sequence) as defined herein above, whose expression level is increased malignant, hormone-sensitive prostate cancer cell or tissue or in any type of sample comprising such cells or tissues or portions or fragments thereof, when comparing to a control level, preferably when comparing to the expression in normal tissue or benign prostate tumor tissue. The term also refers to any expression product of said genetic unit or sequence, in particular to a PDE4D7 mRNA transcript, a polypeptide or protein encoded by the PDE4D7 transcript or variants or fragments thereof, as well as homologous derivatives thereof as described herein above.

The term "expression level" as used herein refers to the amount of PDE4D7 transcript and/or PDE4D7 protein derivable from a defined number of cells or a defined tissue portion, preferably to the amount of PDE4D7 transcript and/or PDE4D7 protein obtainable in a standard nucleic acid (e.g. RNA) or protein extraction procedure. Suitable extraction methods are known to the person skilled in the art.

The term "control level" (or "control state"), as used herein, relates to an expression level which may be determined at the same time and/or under similar or comparable conditions as the test sample by using (a) sample(s) previously collected and stored from a subject/subjects whose condition or disease state, e.g. non-cancerous, normal or benign prostate tumor, advanced prostate cancer etc. is/are known. The term "disease state" or "cancerous disease state" relates to any state or type of cellular or molecular condition between a non-cancerous cell state and (including) a terminal cancerous cell state. Preferably, the term includes different cancerous proliferation/developmental stages or levels of tumor development in the organism between (and excluding) a non-cancerous cell state and (including) a terminal cancerous cell state. Such developmental stages may include all stages of the TNM (Tumor, Node, Metastasis) classification system of malignant tumors as defined by the UICC, e.g. stages 0 and I to IV. The term also includes stages before TNM stage 0, e.g. developmental stages in which cancer biomarkers known to the person skilled in the art show a modified expression or expression pattern.

The expression level as mentioned above may preferably be the expression level of PDE4D7 as defined herein above. Alternatively or additionally, the expression level may also be the expression level of any other suitable gene or genetic element expressed in a cell, preferably in the context of PDE4D7, e.g. the expression level of another phosphodiesterase, the expression level of a housekeeping gene, e.g. GAPDH or PBGD.

The term "cancerous" relates in the context of the present invention to a cancerous disease state as defined herein above.

The term "non-cancerous" relates in the context of the present invention to a condition in which neither benign nor malign proliferation can be detected. Suitable means for said detection are known in the art.

A preferred control level in the context of the present invention is the expression of PDE4D7 in normal, i.e. healthy or non-cancerous tissue or the expression of PDE4D7 in benign prostate tumor tissue. The term "benign prostate tumor" as used herein refers to a prostate tumor which lacks all three of the malignant properties of a cancer, i.e. does not grow in an unlimited, aggressive manner, does not invade surrounding tissues, and does not metastasize. Typically, a benign prostate tumor implies a mild and non-progressive prostate neoplastic or swelling disease lacking the invasive properties of a cancer. Furthermore, benign prostate tumors are typically encapsulated, and thus inhibited in their ability to behave in a malignant manner. A benign tumor or a healthy condition may be determined by any suitable, independent molecular, histological or physiological method known to the person skilled in the art.

Alternatively, the control level may be determined by a statistical method based on the results obtained by analyzing previously determined expression level(s) of the PDE4D7 marker gene of the present invention in samples from subjects whose disease state is known. Furthermore, the control level can be derived from a database of expression patterns or expression levels from previously tested subjects, tissues or cells. Moreover, the expression level of the marker genes of the present invention in a biological sample to be tested may be compared to multiple control levels, whose control levels are determined from multiple reference samples. It is preferred to use a control level determined from a reference sample derived from a tissue type similar to that of the patient-derived biological sample. It is particularly preferred to use sample(s) derived from a subject/subjects whose disease state is non-cancerous as defined herein above, i.e. which present a health condition in which neither benign nor malign proliferation can be detected. It is also particularly preferred to use sample(s) derived from a subject/subjects having benign prostate tumor as defined herein above, i.e. which present a health condition in which benign proliferation can be detected. In another embodiment of the present invention, the control level can be determined from a reference sample derived from a subject who has been diagnosed to suffer from prostate cancer, e.g. from hormone-independent or hormone-resistant prostate cancer.

Alternatively, reference samples may comprise material derived from cell lines, e.g. immortalized cancer cell lines, or be derived from tissue xenografts. Preferably, material derived from prostate cancer cell lines or material derived from tissue xenografts with human prostate tissue, in particular with benign and tumor-derived human prostate tissue, may be comprised in a reference sample according to the present invention. Examples of preferred cancer cell lines comprise cells lines PC346P, PC346B, LNCaP, VCaP, DuCaP, PC346C, PC3, DU145, PC346CDD, PC346Flu1, PC346Flu2. Examples of preferred xenografts comprise PC295, PC310, PC-EW, PC82, PC133, PC135, PC324 and PC374. Preferably an entire panel of cell lines and xenografts may be used, e.g. the human PC346 panel.

In a further, preferred alternative, reference samples may be derived from patient tissues, or tissue panels or tissue collections obtained in clinical environments. The samples may, for example, be obtained from male patients undergoing surgery. The samples may be derived from any suitable tissue type, e.g. from prostate tissue or lymph nodes. Preferred examples of patient tissue collections are derived from surgical procedures (e.g., prostatectomy).

Moreover, it is preferred to use the standard value of the expression levels of the PDE4D7 marker of the present invention in a population with a known disease state, e.g. a population having benign prostate tumor or a healthy population. The standard value may be obtained by any method known in the art. For example, a range of mean±2 SD (standard deviation) or mean±3 SD may be used as standard value.

Furthermore, the control level may also be determined at the same time and/or under similar or comparable conditions as the test sample by using (a) sample(s) previously collected and stored from a subject/subjects whose disease state is/are known to be cancerous, i.e. who have independently been diagnosed to suffer from prostate cancer, in particular malignant, hormone-sensitive prostate cancer.

In the context of the present invention, a control level determined from a biological sample that is known not to be cancerous, e.g. is a healthy tissue sample or a benign prostate tumor sample, is called "normal control level".

If the control level is determined from a cancerous biological sample, in particular a sample from a subject for which hormone-resistant cancer was diagnosed independently, it may be designated as "cancerous control level".

The term "prostate cancer" relates to a cancer of the prostate gland in the male reproductive system, which occurs when cells of the prostate mutate and begin to multiply out of control. Typically, prostate cancer is linked to an elevated level of prostate-specific antigen (PSA). In one embodiment of the present invention the term "prostate cancer" relates to a cancer showing PSA levels above 4.0. In another embodiment the term relates to cancer showing PSA levels above 2.0. The term "PSA level" refers to the concentration of PSA in the blood in ng/ml.

The term "malignant, hormone-sensitive prostate cancer" means that the growth and proliferation of prostate cancer or prostate cancer cell lines is sensitive on male sex hormone stimulation. The term "sensitive" relates to situations in which the prostate cancer or prostate cancer cell line shows a biochemical or cellular reaction pattern in the presence of male sex hormones, but does need a male sex hormone for growth and/or proliferation. A hormone-sensitive prostate is accordingly understood as a malignant prostate tumor that has developed from pre-malignant forms like PIN (Prostate Intraepithelial Neoplasia) and is characterized by the fact that its growth is still dependent on the presence of the male sex hormones androgens. In contrast, once such tumors are treated by hormone depletion therapies those cancers typically develop into a hormone-resistant form that grows independent of the presence of androgens.

The term "hormone-resistant prostate cancer" thus means that the growth and proliferation of prostate cancer or prostate cancer cell lines is resistant to male sex hormone stimulation. The term also relates to a late prostate cancer developmental stage which is no longer amenable to an administration of anti-hormones, preferably anti-androgens as defined herein above.

The term "male sex hormone" as used herein refers to an androgen, preferably to testosterone, androstenedione, dihydrotestosterone, dehydroepiandrosterone, androstenediol or androsterone.

In a further aspect the present invention relates to the use of PDE4D7 as a marker for diagnosing, detecting, monitoring or prognosticating malignant, hormone-sensitive prostate cancer or the progression towards malignant, hormone-sensitive prostate cancer.

The term "diagnosing malignant, hormone-sensitive prostate cancer" as used herein means that a subject or individual may be considered to be suffering from a malignant, hormone-sensitive prostate cancer, when the expression level of the PDE4D7 marker of the present invention is increased or up-regulated, compared to a control level as defined herein above, preferably if compared to the normal control level as defined herein above. The term "diagnosing" also refers to the conclusion reached through that comparison process.

The term "increased" or "increased expression level" or "up-regulated expression level" or "increase of expression level" (which may be used synonymously) in the context of the present invention thus denotes a raise in the expression level between a situation to be analyzed, e.g. a situation derivable from a patient's sample, and a reference point, which could either be a normal control level or cancerous control level derivable from any suitable prostate tumor or cancer stage known to the person skilled in the art. Expression levels are deemed to be "increased" when the PDE4D7 gene expression, e.g. in a sample to be analyzed, differs by, i.e. is elevated by, for example, 5%, 6%, 7%, 8%, 9%, 10%, 15%, 20%, 25%, 30%, 40%, 50%, or more than 50% in comparison to a control level, or by at least 0.1 fold, at least 0.2 fold, at least 1 fold, at least 2 fold, at least 5 fold, or at least 10 fold or more in comparison to a control level. The control level may either be a normal control level or a cancerous control level as defined herein above. If a comparison with a cancerous control level is to be carried out, an additional comparison with a normal control level is preferred. Such an additional comparison allows for the determination of a tendency of the modification, e.g. the magnitude of an increase of the expression level may be observed and/or corresponding conclusions may be drawn. Preferred is a comparison to a benign prostate tumor, or to a healthy tissue or a sample derived from a healthy individual.

In a further embodiment, an additional similarity in the overall gene expression pattern between a sample obtained from a subject and a reference as defined herein above, which is cancerous, indicates that the subject is suffering from a prostate cancer. In another embodiment of the present invention, the diagnosis may be combined with the elucidation of additional cancer biomarker expression levels, in particular prostate cancer biomarkers. Suitable biomarkers, in particular prostate cancer biomarker, would be known to the person skilled in the art. For example, the expression of biomarkers like PSA may be tested.

A malignant, hormone-sensitive prostate cancer may be considered as being diagnosed when the expression level of the PDE4D7 marker of the present invention is increased, compared to the normal control level as defined herein above.

In a further preferred embodiment a malignant, hormone-sensitive prostate cancer may considered as being diagnosed if the PDE4D7 expression level, as defined herein above, is increased by a value of between 20% to 80%, preferably by a value of 30%, 40%, 50%, 60% or 70% in a test sample in comparison to a control level. The control level may either be a normal control level or a cancerous control level, as defined herein above. In a particularly preferred embodiment a malignant, hormone-sensitive prostate cancer may considered as being diagnosed if the PDE4D7 expression level, as defined herein above, is increased by a factor of 1.5- to 10-fold, preferably by a factor of 2- to 5-fold in a test sample in comparison to a normal control level, in particular a healthy tissue or a benign prostate tumor.

The term "detecting malignant, hormone-sensitive prostate cancer" as used herein means that the presence of a malignant, hormone-sensitive prostate cancer disease or disorder in an organism may be determined or that such a disease or disorder may be identified in an organism. The determination or identification of a malignant, hormone-sensitive prostate cancer disease or disorder may be accomplished by a comparison of the expression level of the PDE4D7 marker of the present invention and the normal control level as defined herein above. A malignant, hormone-sensitive prostate cancer may be detected when the expression level of the PDE4D7 marker is increased in comparison to the normal control level as defined herein above. In a preferred embodiment of the present invention a malignant, hormone-sensitive prostate cancer may be detected if the expression level of the PDE4D7 marker is similar to an expression level of an established, e.g. independently established, prostate cancer cell or cell line, e.g. a malignant, hormone-sensitive prostate cancer cell line, or a cell line as mentioned herein above.

The term "monitoring malignant, hormone-sensitive prostate cancer" as used herein relates to the accompaniment of a diagnosed or detected malignant, hormone-sensitive prostate cancer disease or disorder, e.g. during a treatment procedure or during a certain period of time, typically during 2 months, 3 months, 4 months, 6 months, 1 year, 2 years, 3 years, 5 years, 10 years, or any other period of time. The term "accompaniment" means that states of disease as defined herein above and, in particular, changes of these sates of disease may be detected by comparing the expression level of the PDE4D7 marker of the present invention in a sample to a normal control level as defined herein above, preferably a control expression level derived from a benign tumor control or a healthy control or to the expression level of an established, e.g. independently established, prostate cancer cell or cell line, e.g. a malignant, hormone-sensitive prostate cancer cell line, or a cell line in any type of periodical time segment, e.g. every week, every 2 weeks, every month, every 2, 3, 4, 5, 6, 7, 8, 9, 10, 11 or 12 month, every 1.5 year, every 2, 3, 4, 5, 6, 7, 8, 9 or 10 years, during any period of time, e.g. during 2 weeks, 3 weeks, 1, 2, 3, 4, 5, 6, 7, 8, 9, 10, 11, 12 months, 1.5, 2, 3, 4, 5, 6, 7, 8, 9, 10, 15 or 20 years, respectively. The established, e.g. independently established, prostate cancer cell or cell line giving rise to an additional control level may be derived from samples corresponding to different stages of cancer development, e.g. stages 0 and I to IV of the TNM classification system. In a preferred embodiment of the present invention the term relates to the accompaniment of a diagnosed prostate cancer, more preferably of a malignant, hormone-sensitive prostate cancer. The monitoring may also include the detection of the expression of additional genes or genetic elements, e.g. housekeeping genes like GAPDH or PBGD, or other phosphodiesterases, preferably PDE4D5.

The term "prognosticating malignant, hormone-sensitive prostate cancer" as used herein refers to the prediction of the course or outcome of a diagnosed or detected malignant, hormone-sensitive prostate cancer, e.g. during a certain period of time, during a treatment or after a treatment. The term also refers to a determination of chance of survival or recovery from the disease, as well as to a prediction of the expected survival time of a subject. A prognosis may, specifically, involve establishing the likelihood for survival of a subject during a period of time into the future, such as 6 months, 1 year, 2 years, 3 years, 5 years, 10 years or any other period of time.

The term "progression towards malignant, hormone-sensitive prostate cancer" as used herein relates to a switch between different stages of cancer development, e.g. stages 0 and I to IV of the TNM classification, or any other stage or sub-stage, starting from a healthy condition up to malignant, hormone-sensitive prostate cancer. Typically such switches are accompanied by a modification of the expression level of PDE4D7, typically an increase, in a test sample in comparison to a previous test sample from the same individual, e.g. in comparison to a sample derived from a benign prostate tumor control or a healthy tissue control. A progression towards malignant, hormone-sensitive prostate cancer may be considered as being detected or diagnosed if the PDE4D7 expression level, as defined herein above, is increased by a value of between 3% to 50%, preferably by a value of 10%, 15%, 20% or 25% in a test sample in comparison to a previous test sample from the same individual. The modification may be detected over any period of time, preferably over 1, 2, 3, 4, 5, 6, 7, 8, 9, 10, 11, 12 months, 1.5, 2, 3, 4, 5, 6, 7, 8, 9, 10, 15 or 20 years, i.e. the value indicated above may be calculated by comparing the expression level of PDE4D7 at a first point in time and at a second point in time after the above indicated period of time.

In a particularly preferred embodiment of the present invention the term "progression towards malignant, hormone-sensitive prostate cancer" relates to a switch from a healthy state or a benign prostate tumor state to a malignant, hormone-sensitive prostate cancer state. A progression from a healthy state to a hormone-sensitive prostate cancer state may be considered as being detected or diagnosed if the PDE4D7 expression level, as defined herein above, is increased by a value of between 20% to 50%, preferably by a value of 20%, 25%, 30% or 35% in a test sample in comparison to a previous test sample from the same individual, which was diagnosed as being healthy. Alternatively, for the comparison test samples from other individuals may be used, e.g. test samples of healthy individuals. Also envisaged is the use of available database information on the expression or the employment of cancer cell collection samples etc.

A progression from a benign prostate tumor state to a malignant, hormone-sensitive prostate cancer state may be considered as being detected or diagnosed if the PDE4D7 expression level, as defined herein above, is increased by a value of between 3% to 30%, preferably by a value of 5%, 10%, 15%, or 20% in a test sample in comparison to a previous test sample from the same individual, which has been diagnosed as suffering from a benign prostate tumor. Alternatively, for the comparison test samples from other individuals may be used, e.g. test samples of individuals diagnosed to suffer from benign prostate tumors. Also envisaged is the use of available database information on the expression or the employment of cancer cell collection samples etc.

The modification may be detected over any period of time, preferably over 1, 2, 3, 4, 5, 6, 7, 8, 9, 10, 11, 12 months, 1.5, 2, 3, 4, 5, 6, 7, 8, 9, 10, 15 or 20 years, i.e. the value indicated above may be calculated by comparing the expression level of PDE4D7 at a first point in time and at a second point in time after the above indicated period of time.

In a further embodiment the present invention relates to the diagnosis and detection of a predisposition for developing malignant, hormone-sensitive prostate cancer. A "predisposition for developing malignant, hormone-sensitive prostate cancer" in the context of the present invention is a state of risk of developing malignant, hormone-sensitive prostate cancer. Preferably a predisposition for developing malignant, hormone-sensitive prostate cancer may be present in cases in which the PDE4D7 expression level as defined herein above is above a normal or cancerous control level as defined herein above, i.e. a reference expression level derived from tissues or samples of a subject which are evidently healthy. The term "above" in this context relates to an expression level of PDE4D7 which is increased by about 2% to 20% in comparison to such a healthy control level, preferably increased by about 15%. In a specific embodiment the expression level of PDE4D7 may be above a normal control level and at the same time below a cancerous control level. The term "below" as used herein means that the expression level of PDE4D7 is decreased by about 5% to 10% in comparison to such a cancerous control level, preferably decreased by about 7%. Alternatively, a predisposition for developing malignant, hormone-sensitive prostate cancer in the context of the present invention may be given in situations in which the PDE4D7 expression level as defined herein above is be above a normal control level and/or above or below a cancerous control level as defined herein above and in which further, alternative cancer markers, e.g. PSA, show no modification of expression level or the expression pattern. Suitable further cancer markers are known to the person skilled in the art.

Thus, a predisposition for malignant, hormone-sensitive prostate cancer may be considered as being diagnosed or detected if one of the above depicted situations is observed.

The difference between the expression levels of a test biological sample and a control level can be normalized to the expression level of further control nucleic acids, e.g. housekeeping genes whose expression levels are known not to differ depending on the cancerous or non-cancerous state of the cell. Exemplary control genes include inter alia β-actin, glycerinaldehyde 3-phosphate dehydrogenase (GAPDH), porphobilinogen deanimase (PBGD) and ribosomal protein P1. The normalization may also be carried out with other phosphodiesterases, preferably with a human phosphodiesterase showing an unaltered expression pattern in different tumor stages. A preferred phosphodiesterase is any isoform of PDE4D except PDE4D7, more preferred is PDE4D5.

In the context of the present invention, the terms "diagnosing" and "prognosticating" are also intended to encompass predictions and likelihood analyses. PDE4D7 as a marker may accordingly be used clinically in making decisions concerning treatment modalities, including therapeutic intervention or diagnostic criteria such as a surveillance for the disease. According to the present invention, an intermediate result for examining the condition of a subject may be provided. Such intermediate result may be combined with additional information to assist a doctor, nurse, or other practitioner to diagnose that a subject suffers from the disease. Alternatively, the present invention may be used to detect cancerous cells in a subject-derived tissue, and provide a doctor with useful information to diagnose that the subject suffers from the disease.

A subject or individual to be diagnosed, monitored or in which a malignant, hormone-sensitive prostate cancer, a progression towards malignant, hormone-sensitive prostate cancer or a predisposition for malignant, hormone-sensitive prostate cancer is to be detected or prognosticated according to the present invention is an animal, preferably a mammal, more preferably a human being.

Particularly preferred is the use of molecular imaging tools as known to the person skilled in the art, e.g. magnetic resonance imaging (MRI) and/or magnetic photon resonance imaging (MPI) technology in the context of using PDE4D7 as a marker for diagnosing, detecting, monitoring or prognosticating malignant, hormone-sensitive prostate cancer of the progression towards malignant, hormone-sensitive prostate cancer. For example, PDE4D7 may be used as a marker for diagnosing, detecting, monitoring or prognosticating malignant, hormone-sensitive prostate cancer or the progression towards malignant, hormone-sensitive prostate cancer in approaches like MRI or MPI that allows for online detection of the diagnostic marker within a human subject.

In a further aspect the present invention relates to a composition for diagnosing, detecting, monitoring or prognosticating malignant, hormone-sensitive prostate cancer or the progression towards malignant, hormone-sensitive prostate cancer or a predisposition for malignant, hormone-sensitive prostate cancer in an individual. The composition according to the present invention may comprise a nucleic acid and/or peptide affinity ligand for the PDE4D7 expression product or protein.

The term "nucleic acid affinity ligand for the PDE4D7 expression product" as used herein refers to a nucleic acid molecule being able to specifically bind to a PDE4D7 transcript or a DNA molecule derived from splice variant 7 of PDE4D, even more preferably to the DNA sequence depicted in SEQ ID NO: 1 or to the complementary DNA sequence of the sequence depicted in SEQ ID NO: 1 or a corresponding RNA molecule. The nucleic acid affinity ligand may also be able to specifically bind to a DNA sequence being at least 75%, 80%, 85%, 90%, 91%, 92%, 93%, 94%, 95%, 96%, 97%, 98% or 99% identical to the sequence as set forth in SEQ ID NO: 1 or a DNA sequence encoding an amino acid sequence being at least 75%, 80%, 85%, 90%, 91%, 92%, 93%, 94%, 95%, 96%, 97%, 98% or 99% identical to the sequence as set forth in SEQ ID NO: 2 or to any fragments of said sequences.

The term "peptide affinity ligand for the PDE4D7 protein" as used herein refers to a peptide molecule being able to specifically bind to the PDE4D7 protein. The peptide molecule may preferably be able to specifically bind to a protein or polypeptide comprising the amino acid sequence as set forth in SEQ ID NO: 2. The peptide affinity ligand may also be able to specifically bind to a protein or polypeptide comprising an amino acid sequence encoded by a DNA sequence being at least 75%, 80%, 85%, 90%, 91%, 92%, 93%, 94%, 95%, 96%, 97%, 98% or 99% identical to the sequence as set forth in SEQ ID NO: 1 or to a protein or polypeptide comprising an amino acid sequence being at least 75%, 80%, 85%, 90%, 91%, 92%, 93%, 94%, 95%, 96%, 97%, 98% or 99% identical to the sequence as set forth in SEQ ID NO: 2 or to any fragments of said sequences. The term "peptide" refers to any type of amino acid sequence comprising more than 2 amino acids, e.g. polypeptide structures, protein structures or functional derivatives thereof Furthermore, the peptide may be combined with further chemical moieties or functionalities.

The term "expression product" as used herein refers to a PDE4D7 transcript or an mRNA molecule generated by the expression of the PDE4D gene. More preferably, the term relates to a processed PDE4D transcript as defined herein above, e.g. via the sequence as set forth in SEQ ID NO: 1.

In a preferred embodiment of the present invention the composition of the present invention comprises nucleic acid and/or peptide affinity ligands selected from the group consisting of a set of oligonucleotides specific for the PDE4D7 expression product, a probe specific for the PDE4D7 expression product, an aptamer specific for the PDE4D7 expression product or for the PDE4D7 protein, an antibody specific for the PDE4D7 protein and an antibody variant specific for the PDE4D7 protein.

The composition of the present invention may, for example, comprise a set of oligonucleotides specific for the PDE4D7 expression product and/or a probe specific for the PDE4D7 expression product. The term "oligonucleotide specific for the PDE4D7 expression product" as used herein refers to a nucleotide sequence which is complementary to the sense- or antisense-strand of splice variant 7 of PDE4D. Preferably, the oligonucleotide is complementary to the DNA sequence depicted in SEQ ID NO: 1 or to the complementary DNA sequence of the sequence depicted in SEQ ID NO: 1. The oligonucleotide sequence may also be complementary to a DNA sequence being at least 75%, 80%, 85%, 90%, 91%, 92%, 93%, 94%, 95%, 96%, 97%, 98% or 99% identical to the sequence as set forth in SEQ ID NO: 1 or a DNA sequence encoding an amino acid sequence being at least 75%, 80%, 85%, 90%, 91%, 92%, 93%, 94%, 95%, 96%, 97%, 98% or 99% identical to the sequence as set forth in SEQ ID NO: 2.

The oligonucleotide may have any suitable length and sequence known to the person skilled in the art, as derivable from the sequence of SEQ ID NO: 1 or its complement. Typically, the oligonucleotide may have a length of between 8 and 60 nucleotides, preferably of between 10 and 35 nucleotides, more preferably a length of 11, 12, 13, 14, 15, 16, 17, 18, 19, 20, 21, 22, 23, 24, 25, 26, 27, 28, 29, 30, 31, 32 or 33 nucleotides. Oligonucleotide sequences specific for the PDE4D7 expression product may be defined with the help of software tools known to the person skilled in the art.

In a further embodiment of the present invention the oligonucleotide sequences may be complementary to sequences localized in exon 1 or exon 2 of the PDE4D7 gene, to sequences localized in the boundary between exon 1 and exon 2 of the PDE4D7 gene or to sequences localized in exon 2 of the PDE4D7 gene solely, preferably to a stretch of 271 unique nucleotides of PDE4D7, i.e. 42 nucleotides at the 3' end of exon 1 and 229 5'-terminal nucleotides of exon 2 of PDE4D. For instance, an oligonucleotide usable as a forward primer may be localized at the boundary between exon 1 and exon 2 of the PDE4D7 gene and the oligonucleotide usable as a reverse primer may be localized in exon 2 of the PDE4D7 gene.

In a preferred embodiment of the present invention the set of oligonucleotides has the sequences as set forth in SEQ ID NO: 3 and SEQ ID NO: 4. Further preferred are the oligonucleotides having or comprising the sequence as set forth in SEQ ID NO: 10 and/or SEQ ID NO: 11.

The term "probe specific for the PDE4D7 expression product" as used herein means a nucleotide sequence which is complementary to the sense- or antisense-strand of splice variant 7 of PDE4D. Preferably, the probe is complementary to the DNA sequence depicted in SEQ ID NO: 1 or to the complementary DNA sequence of the sequence depicted in SEQ ID NO: 1. The probe sequence may also be complementary to a DNA sequence being at least 75%, 80%, 85%, 90%, 91%, 92%, 93%, 94%, 95%, 96%, 97%, 98% or 99% identical to the sequence as set forth in SEQ ID NO: 1 or a DNA sequence encoding an amino acid sequence being at least 75%, 80%, 85%, 90%, 91%, 92%, 93%, 94%, 95%, 96%, 97%, 98% or 99% identical to the sequence as set forth in SEQ ID NO: 2.

The probe may have any suitable length and sequence known to the person skilled in the art, as derivable from the sequence of SEQ ID NO: 1 or its complement. Typically, the probe may have a length of between 6 and 300 nucleotides, preferably of between 15 and 60 nucleotides, more preferably a length of 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50 nucleotides. Probe sequences specific for the PDE4D7 expression product may be defined with the help of software tools known to the person skilled in the art.

In a further embodiment of the present invention the probe sequence may be complementary to a sequence localized in exon 1 or exon 2 of to PDE4D7 gene, preferably to a stretch of 271 unique nucleotides of PDE4D7, i.e. 42 nucleotides at the 3' end of exon 1 and 229 5'-terminal nucleotides of exon 2 of PDE4D. If the probe is to be used for quantitative PCR reactions, e.g. real time PCR, the probe may be designed such that it is localized at a position in between the binding positions of a forward and reverse primer. Preferably, the probe may be designed such that it is localized in the proximity of one of the primer oligonucleotides. More preferably, it may be localized in the proximity of the forward primer.

In a preferred embodiment of the present invention the probe has the sequence as set forth in SEQ ID NO: 5 or SEQ ID NO: 12.

The composition of the present invention may additionally or alternatively comprise an aptamer specific for the PDE4D7 expression product or protein. The term "aptamer specific for the PDE4D7 expression product" as used herein refers to a short nucleic acid molecule, e.g. RNA, DNA, PNA, CNA, HNA, LNA or ANA or any other suitable nucleic acid format known to the person skilled in the art, being capable of specifically binding to splice variant 7 of PDE4D, preferably the DNA molecule derived from splice variant 7 of PDE4D. More preferably, the nucleic acid aptamer molecule may specifically bind to a DNA sequence depicted in SEQ ID NO: 1 or a double stranded derivative thereof The nucleic acid aptamer according to the present invention may also bind to an RNA molecule corresponding to the PDE4D7 transcript, preferably an RNA molecule corresponding to the DNA sequence as set forth in SEQ ID NO: 1.

The nucleic acid aptamer may further be capable of specifically binding to a DNA sequence being at least 75%, 80%, 85%, 90%, 91%, 92%, 93%, 94%, 95%, 96%, 97%, 98% or 99% identical to the sequence as set forth in SEQ ID NO: 1 or a DNA sequence encoding an amino acid sequence being at least 75%, 80%, 85%, 90%, 91%, 92%, 93%, 94%, 95%, 96%, 97%, 98% or 99% identical to the sequence as set forth in SEQ ID NO: 2 or RNA molecules corresponding to these sequences.

Specificity of the nucleic acid aptamer to splice variant 7 of PDE4D may be conferred by a specific binding to sequences solely present in said splice variant, e.g. exon 2 or the exon boundary between exon 1 and exon 2 of PDE4D. In a particular embodiment of the present invention specificity of the nucleic acid aptamer to splice variant 7 of PDE4D may be conferred by a specific binding to a sequence located within a stretch of 271 unique nucleotides of PDE4D7, i.e. 42 nucleotides at the 3' end of exon 1 and 229 5'-terminal nucleotides of exon 2 of PDE4D. Nucleic acid aptamers may be generated according to any suitable method known to the person skilled in the art, e.g. by in vitro selection or SELEX methods. Preferably, nucleic acid aptamers may be generated and/or designed according to the guidance provided in Ellington and Szostak, 1990, Nature, 346:818-822. A nucleic acid aptamer according to the present invention may further be combined with additional moieties, e.g. with interacting portions like biotin or enzymatic functionalities like ribozyme elements.

The term "aptamer specific for the PDE4D7 protein" as used herein refers to a short peptide capable of interacting and specifically binding the PDE4D7 protein. The peptide aptamer may preferably be able to specifically bind to a protein or polypeptide comprising the amino acid sequence as set forth in SEQ ID NO: 2. The peptide aptamer may also be able to specifically bind to a protein or polypeptide comprising an amino acid sequence encoded by a DNA sequence being at least 75%, 80%, 85%, 90%, 91%, 92%, 93%, 94%, 95%, 96%, 97%, 98% or 99% identical to the sequence as set forth in SEQ ID NO: 1 or to a protein or polypeptide comprising an amino acid sequence being at least 75%, 80%, 85%, 90%, 91%, 92%, 93%, 94%, 95%, 96%, 97%, 98% or 99% identical to the sequence as set forth in SEQ ID NO: 2. Typically, a peptide aptamer is a variable peptide loop, comprising for example, 10 to 20 amino acids. In the context of the present invention the peptide aptamer may preferably be attached at one or both ends to a scaffold structure. The scaffold structure may be any molecule, preferably a protein, which has good solubility properties. Suitable scaffold molecules would be known to the person skilled in the art. A preferred scaffold molecule to be used in the context of the present invention is the bacterial protein thioredoxin-A. The aptamer peptide loop may preferably be inserted within a reducing active site of the scaffold molecule. Alternatively, staphylococcal protein A and domains thereof and derivatives of these domains, such as protein Z or lipocalins may be used as scaffold structures in the context of the present invention.

Peptide aptamers may be generated according to any suitable method known to the person skilled in the art, e.g. via yeast two-hybrid approaches.

In another embodiment the present invention relates to an antibody specific for the PDE4D7 protein. Such an antibody is contemplated for any application, use, method, composition, immunoassay, screening method and diagnostic or pharmaceutical composition or kit as defined in the present application. The term "antibody" as used herein refers to immunoglobulin molecules and immunologically active portions of immunoglobulin molecules, i. e. molecules that contain an antigen binding site that immunospecifically binds an antigen. The immunoglobulin molecules of the invention can be of any type (e. g., IgG, IgE, IgM, IgD, IgA and IgY), class (e. g., IgG1, IgG2, IgG3, lgG4, IgA1 and IgA2) or subclass of immunoglobulin molecule.

Antibodies of the present invention may be described or specified in terms of the epitope(s) or portion(s) of the PDE4D7 polypeptide of the present invention which they recognize or specifically bind. Preferred epitopes according to the present invention are amino acids 1-10, 2-11, 3-12, 4-13, 5-14, 6-15, 7-16, 8-17, 9-18, 10-19, 11-20, 12-21, 13-22, 14-23, 15-24, 16-25, 17-26, 18-27, 19-28, 20-29, 21-30, 22-31, 23-32, 24-33, 25-34, 26-35, 27-36, 28-37, 29-38, 30-39, 31-40, 32-41, 33-42, 34-43, 35-44, 36-45, 37-46, 38-47, 39-48, 30-49, 41-50, 42-51, 43-52, 44-53, 45-54, 46-55, 47-56, 48-57, 49-58, 50-59, 51-60, 52-61, 53-62, 54-63, 55-64, 56-65, 57-66, 58-67, 59-68, 60-69, 61-70, 62-71, 63-72, 64-73, 65-74, 66-75, 67-76, 68-77, 69-78, 70-79, 71-80, 72-81, 73-82, 74-83, 75-84, 76-85, 77-86, 78-87, 79-88, 80-89, 81-90, 82-91, 83-92, 84-93, 85-94, 86-95, 87-96, 88-97, 89-98, 90-99, 91-100, 1-20, 2-21, 3-22, 4-23, 5-24, 6-25, 7-26, 8-27, 9-28, 10-29, 11-30, 12-31, 13-32, 14-33, 15-34, 16-35, 17-36, 18-37, 19-38, 20-39, 21-40, 22-41, 23-42, 24-43, 25-44, 26-45, 27-46, 28-47, 29-48, 30-49, 31-50, 32-51, 33-52, 34-53, 35-54, 36-55, 37-56, 38-57, 39-58, 30-59, 41-60, 42-61, 43-62, 44-63, 45-64, 46-65, 47-66, 48-67, 49-68, 50-69, 51-70, 52-71, 53-72, 54-73, 55-74, 56-75, 57-76, 58-77, 59-78, 60-79, 61-80, 62-81, 63-82, 64-83, 65-84, 66-85, 67-86, 68-87, 69-88, 70-89, 71-90, 72-91, 73-92, 74-93, 75-94, 76-95, 77-96, 78-97, 79-98, 80-99, 81-100, 1-30, 2-31, 3-32, 4-33, 5-34, 6-35, 7-36, 8-37, 9-38, 10-39, 11-40, 12-41, 13-42, 14-43, 15-44, 16-45, 17-46, 18-47, 19-48, 20-49, 21-50, 22-51, 23-52, 24-53, 25-54, 26-55, 27-56, 28-57, 29-58, 30-59, 31-60, 32-61, 33-62, 34-63, 35-64, 36-65, 37-66, 38-67, 39-68, 30-69, 41-70, 42-71, 43-72, 44-73, 45-74, 46-75, 47-76, 48-77, 49-78, 50-79, 51-80, 52-81, 53-82, 54-83, 55-84, 56-85, 57-86, 58-87, 59-88, 60-89, 61-90, 62-91, 63-92, 64-93, 65-94, 66-95, 67-96, 68-97, 69-98, 70-99 or 71-100 of the PDE4D7 protein, preferably of the N-terminal portion of the PDE4D7 protein, more preferably of the sequence of SEQ ID NO: 2.

Further comprised are all other suitable epitopes, which can be recognized, determined, described and subsequently be employed according to methods known to the person skilled in the art.

The term "specific for the PDE4D7 protein" as used herein refers to the immunospecific detection and binding of an antibody to an antigenic epitope as defined herein above. The term "specifically binding" excludes non-specific binding but does not necessarily exclude cross-reactivity with other antigens, in particular with antigens comprising the same antigenic epitope detected by the present antibody.

In a preferred embodiment antibodies of the invention include polyclonal, monoclonal, multispecific, human, humanized or chimeric antibodies, single chain antibodies, Fab fragments, Fab' fragments, fragments produced by a Fab expression library, F(ab')2, Fv, disulfide linked Fv, minibodies, diabodies, scFv, sc(Fv)2, whole immunoglobulin molecules, small modular immunopharmaceuticals (SMIP), binding-domain immunoglobulin fusion proteins, camelized antibodies, $V_{HH}$ containing antibodies, anti-idiotypic (anti- Id) antibodies (including, e. g., anti-Id antibodies to antibodies of the invention) and epitope-binding fragments of any of the above.

Most preferably the antibodies are human antigen-binding antibody fragments of the present invention and include Fab, Fab' and F (ab')2, Fv, single-chain Fvs (scFv), sc(Fv)2, single-chain antibodies, disulfide-linked Fvs (sdFv) and fragments comprising either a VL or VH domain.

The term "Fab fragment" as used herein refers to antibody fragments consisting of the first constant domain of the heavy chain (CH1), the constant domain of the light chain (CL), the variable domain of the heavy chain (VH) and the variable domain of the light chain (VL) of an intact immunoglobulin protein. The term "F(ab')2" or "F(ab')2 fragment" as used herein refers to antibody fragments consisting of two first constant domains of the heavy chain (CH1), two constant domains of the light chain (CL), two variable domains of the heavy chain (VH) and two variable domains of the light chain (VL) of an intact immunoglobulin protein, i.e. it comprises two Fab fragments. The term "Fab' fragment" as used herein refers to fragments derived from "F(ab')2" molecules, preferably fragments comprising the S-S linkage in the antibody hinge region. The term "Fv fragments" as used herein refers to antibody fragments consisting of the two variable antibody domains VH and VL. The term "single chain Fv fragment (scFv)" as used herein relates to antibody fragments consisting of the two VH and VL domains linked together by a flexible peptide linker.

The antibodies according to the invention may be from any animal origin including birds and mammals. Preferably, the antibodies are human, murine (e. g., mouse and rat), donkey, monkey, rabbit, goat, guinea pig, camel, horse, or chicken.

The antibodies according to the present invention may be monospecific, bispecific, trispecific or of greater multispecificity. Multispecific antibodies may be specific for different epitopes of a polypeptide of the present invention or may be specific for both a polypeptide of the present invention as well as for a heterologous epitope, such as a heterologous polypeptide or solid support material.

Antibodies of the present invention may also be described or specified in terms of their cross-reactivity. In a particularly preferred embodiment the present invention relates to antibodies that do not bind any other analog, ortholog, or homolog of a polypeptide of the present invention. However, also antibodies that bind polypeptides with at least 95%, at least 90%, at least 85%, at least 80%, at least 75%, at least 70%, at least 65%, at least 60%, at least 55%, and at least 50% identity (as calculated using methods known in the art and described herein) to a polypeptide of the present invention are included in the present invention.

The invention also provides antibodies that may competitively inhibit binding of an antibody to an epitope of the invention as determined by any method known in the art for determining competitive binding, for example via immunoassays. In preferred embodiments, the antibody competitively inhibits binding to the epitope by at least 95%, at least 90%, at least 85%, at least 80%, at least 75%, at least 70%, at least 60%, or at least 50%.

In a further embodiment the antibodies of the invention include derivatives which are modified, for instance by the covalent attachment of any type of molecule to the antibody such that said covalent attachment does not prevent the antibody from spefically binding to the epitope or from generating an anti-idiotypic response. Typical examples of such modifications are glycosylation, acetylation, pegylation, phosphylation, amidation, derivatization by known protecting/blocking groups, proteolytic cleavage, linkage to a cellular ligand or other protein, etc. Chemical modifications may be carried out by known techniques, including specific chemical cleavage, acetylation, formylation etc. Additionally, the derivative may contain one or more non-classical amino acids.

Antibodies may be produced according to any suitable method known to the person skilled in the art. Polyclonal antibodies may be produced by immunization of animals with the antigen of choice. For example, a polypeptide of the invention can be administered to various host animals including any eukaryotic, prokaryotic, or phage clone. Monoclonal antibodies of defined specificity may be produced using, for instance, the hybridoma technology developed by Köhler and Milstein (Köhler and Milstein, 1976, Eur. J. Immunol., 6: 511-519).

Antibody fragments which recognize specific epitopes may be generated by known techniques. For example, Fab and F (ab')2 fragments of the invention may be produced by proteolytic cleavage of immunoglobulin molecules, using enzymes such as papain (to produce Fab fragments) or pepsin (to produce F (ab') 2 fragments).

The term "chimeric antibody" as used herein above refers to a molecule in which different portions of the antibody are derived from different animal species, such as antibodies having a variable region derived from a murine monoclonal antibody and a human immunoglobulin constant region. The term "humanized antibody" as used herein above refers to antibody molecules which bind the desired antigen having one or more complementarity determining regions (CDRs) from the nonhuman species and framework regions from a human immunoglobulin molecule. Techniques for the production of humanized antibodies are known to the person skilled in the art. The term "human antibody" as used herein refers to antibodies having the amino acid sequence of a human immunoglobulin and include antibodies isolated from human immunoglobulin libraries or from animals transgenic for one or more human immunoglobulin.

In further embodiment of the present invention the antibody or fragment thereof as defined herein above may be biotinylated or labeled. The term "biotinylated" as used herein means that said antibody is covalently attached to the molecule biotin. Typically, biotin may be linked to primary amines, e.g. present as lysine side chains in epsilon-amines or N-terminal alpha-amines. Alternatively, the linkage may be performed via sulfhydryl groups, carboxyl groups, sugar groups or residues present on the antibody molecule. Furthermore, the biotinylation may be carried out as non-specific biotinylation.

The term "labeled antibody" as used herein means that said antibody may comprise one or more labels at the C- or N-terminus of the antibody chains. Alternatively, said antibody may also comprise one or more labels at any position throughout the molecule. Preferably said antibody comprises between 1 and 10 labels, which may either be identical or different or any combination thereof. More preferably, the antibody may comprise between 1 and 5 labels, even more preferably one label. Said labels may be any suitable label known to the person skilled in the art, e.g. radioactive, fluorescent or chemiluminescent labels. In a particularly preferred embodiment said label is a radioactive label, an enzymatic label, a fluorescent label, a chemiluminescent or a bioluminescent label.

The term "enzymatic label" relates to labels which comprise enzymatic activities. A typical, preferred example is the horseradish peroxidase enzyme (HRP), which may be tethered or attached to the antibody. This enzyme complex subsequently may catalyze the conversion of a suitable substrate, e.g. a chemiluminescent substrate into a sensitized reagent in the vicinity of the antibody which ultimately lead to the emission of light or production of a color reaction. In particular, enhanced chemiluminescence, which may be used in this context, allows detection of minute quantities of labeled molecules.

The term "radioactive label" relates to labels emitting radioactive radiation, preferably composed of radioactive isotopes. The term "radioactive isotope" in the context of the label relates to any such factor known to the person skilled in the art. More preferably, the term relates to $^3H$, $^{14}C$, $^{32}P$, $^{33}P$, $^{35}S$ or $^{125}I$.

The term "chemiluminescent label" relates to a label which is capable of emitting light (luminescence) with a limited emission of heat as the result of a chemical reaction. Preferably, the term relates to luminol, cyalume, oxalyl chloride, TMAE (tetrakis (dimethylamino) ethylene), pyragallol, lucigenin, acridinumester or dioxetane.

The term "bioluminescent label" relates to a label which is capable of emitting light due to a biochemical reaction. Typically, the term refers to the production of light due to the reaction of a luciferin and a luciferase. In such a reaction scheme, the luciferase catalyzes the oxidation of luciferin resulting in light and an inactive oxyluciferin. For example, an antibody according to the present invention may be linked to a luciferase. Alternatively, the antibody may also be labeled with luciferin. The luciferin and the luciferase as well as a co-factor such as oxygen, may be bound together to form a single photoprotein. This molecule may be linked to an antibody according to the present invention. A light emission may be triggered when a particular compound is present, e.g. a specific type of ion, preferably calcium. Examples of luciferin to be used in the context of the present invention include bacterial luciferin, dino flagellate luciferin, vargulin, coelenterazine and firefly luciferin.

The term "fluorescent label" relates to chemically reactive derivatives of a fluorophores. Typically common reactive groups include amine reactive isothiocyanate derivatives such as FITC and TRITC (derivatives of fluorescein and rhodamine), amine reactive succinimidyl esters such as NHS-fluorescein, and sulfhydryl reactive maleimide activated fluors such as fluorescein-5-maleimide. According to the present invention any suitable fluorescent label known to the person skilled in the art may be used. Preferably, the fluorescent labels FITC, Fluorescein, Fluorescein-5-EX, 5-SFX, Rhodamine Green-X, BodipyFL-X, Cy2, Cy2-OSu, Fluor X, Bodipy TMR-X, Rhodamine, Rhodamine Red-X, Texas Red, Texas Red-X, Bodipy TR-X, Cy3.5-OSu, Alexa fluors, Dylight fluors and/or Cy5.5-OSu may be used. In a more preferred embodiment of the present invention the fluorescent labels 6-FAM, HEX, TET, ROX, Cy3, Cy3-OSu, Cy5, Cy5-Osu, Texas Red or Rhodamine may be used.

Alternatively, antibodies may also be labeled or combined with fluorescent polypeptides, e.g. green fluorescent protein (GFP) as well as derivates thereof known to the person skilled in the art.

These labels may be used either individually or in groups in any combination. In yet another aspect the present invention relates to a nucleic acid molecule encoding the antibody or fragment thereof as defined herein above. The invention also encompasses nucleic acid molecules that hybridize under stringent or lower stringency hybridization conditions, e. g., as defined herein above, to nucleic acid molecules that encode an antibody. Preferably, the antibody encoded by such hybridizing molecules specifically binds to the PDE4D protein, more preferably to the polypeptide of SEQ ID NO: 2 or epitopes contained therein, e.g. as described herein above.

Alternatively, a polynucleotide encoding an antibody may be generated from a nucleic acid from a suitable source.

In a further embodiment of the present invention a nucleic acid molecule encoding the antibody or fragment thereof as defined herein above may be used for recombinant antibody expression. Preferably, such expression vectors contain the antibody coding sequences and appropriate transcriptional and translational control signals. The vectors may either comprise coding sequences for the variable heavy chain or the variable light chain or for both. Such vectors may also include the nucleotide sequence encoding the constant regions of the antibody molecule.

In a preferred embodiment mammalian cells, more preferably Chinese hamster ovary cells (CHO), in conjunction with a vector such as the major intermediate early gene promoter element from human cytomegalovirus may be used as an effective expression system for antibodies. In bacterial systems, a number of expression vectors may be advantageously selected depending upon the use intended for the antibody molecule being expressed.

In another embodiment the present invention relates to a cell that produces the antibody or fragment thereof as defined herein above. Such a cell may be a hybridoma cell as defined herein above or a cell which expresses a nucleic acid molecule encoding an antibody according to the present invention. Particularly preferred are cells or cell lines which stably express the antibody molecule.

Once an antibody molecule of the invention has been produced, synthesized, or recombinantly expressed, it may be purified by any method known in the art for purification of an immunoglobulin molecule, for example, by chromatography (e.g., ion exchange, affinity, preferably by affinity for the specific antigen after Protein A, and sizing column chromatography), centrifugation, differential solubility, or by any other standard technique for the purification of proteins known to the person skilled in the art.

In addition, the antibodies of the present invention or fragments thereof can be fused to any heterologous polypeptide sequence, e.g. in order to facilitate antibody purification or to provide target means for the antibody. Also envisaged is the fusion to cytotoxic heterologous proteins or molecules, e.g. toxins etc. Corresponding examples and techniques would be known to the person skilled in the art.

In another preferred embodiment of the present invention the composition, e.g. the diagnostic composition, may comprise, or may additionally comprise, an antibody specific for the PDE4D7 protein, preferably a monoclonal or polyclonal antibody variants or fragments like a single chain antibody, a diabody, a minibody, a single chain Fv fragment (sc(Fv)), a sc(Fv)$_2$ antibody, a Fab fragment or a F(ab')$_2$ fragment based on a monoclonal PDE4D7 specific antibody, a small modular immunopharmaceutical (SMIP), a binding-domain immunoglobulin fusion protein, a camelized antibody or V$_{HH}$ containing antibody etc. as defined herein above. In a specific embodiment of the present invention commercially available anti-PDE4D7 antibodies like NB300-652 (Novus Biologicals, Inc.) or GTX14629 (GeneTex, Inc.) may be comprised in the composition or may be used, e.g. diagnostically.

An affinity ligand, as described herein above, may be labeled with various markers or may be detected by a secondary affinity ligand, labeled with various markers, to allow detection, visualization and/or quantification. This can be accomplished by using any suitable labels, which can be conjugated to the affinity ligand capable of interaction with the PDE4D7 expression product or the PDE4D7 protein or to any secondary affinity ligand, using any suitable technique or methods known to the person skilled in the art. The term "secondary affinity ligand" refers to a molecule which is capable of binding to the affinity ligand as defined herein above (i.e. a "primary affinity ligand" if used in the context of a system with two interacting affinity ligands). The binding interaction is preferably a specific binding.

Examples of labels that can be conjugated to a primary and/or secondary affinity ligands include fluorescent dyes or metals (e.g. fluorescein, rhodamine, phycoerythrin, fluorescamine), chromophoric dyes (e.g. rhodopsin), chemiluminescent compounds (e.g. luminal, imidazole) and bioluminescent proteins (e.g. luciferin, luciferase), haptens (e.g. biotin).

In a particularly preferred embodiment an affinity ligand to be used as a probe, in particular a probe specific for the PDE4D7 expression product as defined herein above, may be labeled with a fluorescent label like 6-FAM, HEX, TET, ROX, Cy3, Cy5, Texas Red or Rhodamine, and/or at the same time with a quenching label like TAMRA, Dabcyl, Black Hole Quencher, BHQ-1 or BHQ-2. A variety of other useful fluorescents and chromophores are described in Stryer, 1968, Science, 162:526-533. Affinity ligands may also be labeled with enzymes (e.g. horseradish peroxidase, alkaline phosphatase, beta-lactamase), radioisotopes (e.g. $^{3}H$, $^{14}C$, $^{32}P$, $^{33}P$, $^{35}S$, $^{125}I$, $^{11}C$, $^{13}N$, $^{15}O$, $^{18}F$, $^{64}Cu$, $^{62}Cu$, $^{124}I$, $^{76}Br$, $^{82}Rb$, $^{68}Ga$ or $^{18}F$) or particles (e.g. gold).

The different types of labels may be conjugated to an affinity ligand using various chemistries, e.g. the amine reaction or the thiol reaction. However, other reactive groups than amines and thiols can also be used, e.g. aldehydes, carboxylic acids and glutamine.

In a preferred embodiment of the present invention the nucleic acid affinity ligand or peptide affinity ligand of the present invention may be modified to function as a contrast agent. The term "contrast agent" as used herein refers to a molecular compound that is capable of specifically interacting with the PDE4D7 marker and which can be detected by an apparatus positioned outside the human or animal body. Preferably, such contrast agents are suitable for use in imaging techniques, e.g. in magnetic resonance imaging (MRI) or magnetic photon imaging (MPI). The term "specifically interacting" refer to the property of a molecular compound to preferentially interact with the PDE4D7 marker on the cell surface of cells being present within the human or animal body over other proteins that are expressed by such cells. Preferred contrast agents which may also be designated as contrast agent compositions will be capable of specifically detecting molecules having the nucleotide sequence of SEQ ID NO: 1 or the amino acid sequence of SEQ ID NO: 2 or derivatives or homologous variants thereof as defined herein above. Preferred contrast agents are aptamers specific for the PDE4D7 expression product or for the PDE4D7 protein as defined herein above as well as antibodies specific for the PDE4D7 protein as defined herein above or are linked or associated with said aptamers.

Contrast agents, aside from their property of being capable of specifically recognizing the PDE4D7 marker will in addition typically comprise a further molecule which is detectable by the specific detection technology used. The term "modified to function" as used herein thus refers to any suitable modifications known to the person skilled in the art, which may be necessary in order to allow the use of the contrast agent in molecular imaging methods, in particular in MRI or MPI. For example, if fluorescent spectroscopy is used as a detection means, such molecules may comprise fluorophores as detectable marker molecules that can be excited at a specific wavelength. Alternatively, a radioactive label, e.g. a radioisotope as described herein above may be employed. With respect to preferred contrast agents in accordance with the invention that are suitable for MRI, the contrast agents such as the above described antibodies may comprise a marker molecule which is detectable by MRI. Such detectable labels include e.g. USPIOS and 19Fluor.

In a specific embodiment of the present invention a composition may additionally comprise accessory ingredients like PCR buffers, dNTPs, a polymerase, ions like bivalent cations or monovalent cations, hybridization solutions, secondary affinity ligands like, e.g. secondary antibodies, detection dyes and any other suitable compound or liquid necessary for the performance of a detection based on any of the affinity ligands or contrast agents as defined herein above, which is known to the person skilled in the art.

In another aspect the present invention relates to the use of a nucleic acid or peptide affinity ligand for the PDE4D7 expression product or protein, as defined herein above, for the preparation of a composition for diagnosing, detecting, monitoring or prognosticating malignant, hormone-sensitive prostate cancer or the progression towards malignant, hormone-sensitive prostate cancer or a predisposition for malignant, hormone-sensitive prostate cancer in an individual, as described herein above.

In a preferred embodiment the present invention relates to the use of a set of oligonucleotides specific for the PDE4D7 expression product and/or a probe specific for the PDE4D7 expression product, as defined herein above, for the preparation of a composition for diagnosing, detecting, monitoring or prognosticating malignant, hormone-sensitive prostate cancer or the progression towards malignant, hormone-sensitive prostate cancer or a predisposition for malignant, hormone-sensitive prostate cancer in an individual, as described herein above. In another preferred embodiment the present invention relates to the use of an aptamer specific for the PDE4D7 expression product or protein, as defined herein above, for the preparation of a composition for diagnosing, detecting, monitoring or prognosticating malignant, hormone-sensitive prostate cancer or the progression towards malignant, hormone-sensitive prostate cancer or a predisposition for malignant, hormone-sensitive prostate cancer in an individual, as described herein above.

In a further embodiment the present invention relates to the use of an antibody specific for the PDE4D7 protein and/or an antibody variant specific for the PDE4D7 protein, as defined herein above, for the preparation of a composition for diagnosing, detecting, monitoring or prognosticating cancer or the progression of cancer or a predisposition for cancer in an individual, as described herein above.

In a preferred embodiment of the present invention a composition as defined herein above is a diagnostic composition.

In yet another embodiment the present invention relates to the use of an antibody specific for the PDE4D7 protein and/or an antibody variant specific for the PDE4D7 protein, as defined herein above, for the preparation of a composition for the treatment of cancer.

In another aspect the present invention relates to the use of an antibody specific for the PDE4D7 protein and/or an antibody variant specific for the PDE4D7 protein for detecting, diagnosing, monitoring or prognosticating cancer or for the treatment of cancer. In a preferred embodiment of the present invention the antibody as described herein above is used for the detecting, diagnosing, monitoring or prognosticating prostate cancer or for the treatment of prostate cancer. In an even more preferred embodiment, the antibody as described herein is used for the detecting, diagnosing, monitoring or prognosticating malignant, hormone-sensitive prostate cancer or for the treatment of malignant, hormone-sensitive prostate cancer.

In another aspect the present invention relates to a diagnostic kit for detecting, diagnosing, monitoring or prognosticating malignant, hormone-sensitive prostate cancer or the progression towards malignant, hormone-sensitive prostate cancer or a predisposition for malignant, hormone-sensitive prostate cancer, comprising a set of oligonucleotides specific for the PDE4D7 expression product, a probe specific for the PDE4D7 expression product and/or an aptamer specific for the PDE4D7 expression product or protein and/or an antibody specific for the PDE4D7 protein and an antibody variant specific for the PDE4D7 protein.

Typically, the diagnostic kit of the present invention contains one or more agents allowing the specific detection of PDE4D7 as defined herein above. The agents or ingredients of a diagnostic kit may, according to the present invention, be comprised in one or more containers or separate entities. The nature of the agents is determined by the method of detection for which the kit is intended. Where detection at the PDE4D7 mRNA expression level, i.e. via the PDE4D7 expression product, is intended, the agents to be comprised may be a set of oligonucleotides specific for the PDE4D7 expression product and/or a probe specific for the PDE4D7 expression product as defined herein above, which may be optionally labeled according to methods known in the art, e.g. with labels described herein above. In addition or alternatively an aptamer specific for the PDE4D7 expression production may be comprised. Where detection is at the PDE4D7 protein level is intended, the agents to be comprised may be one or more antibodies or compounds containing an antigen-binding fragment of an antibody or antibody variants specific for the PDE4D7 protein, as described herein above. In addition or alternatively, an aptamer specific for the PDE4D7 protein may be comprised. Alternatively, a diagnostic kit may comprise a contrast agent as defined herein above.

The presence of specific proteins may also be detected using other compounds that specifically interact with PDE4D7, e.g. specific substrates or ligands.

Preferably, a diagnostic kit of the present invention contains detection reagents for PDE4D7 expression product or the PDE4D7 protein. Such detection reagents comprise, for example, buffer solutions, labels or washing liquids etc. Furthermore, the kit may comprise an amount of a known nucleic acid molecule or protein, which can be used for a calibration of the kit or as an internal control. Typically, a diagnostic kit for the detection of PDE4D7 expression products may comprise accessory ingredients like a PCR buffers, dNTPs, a polymerase, ions like bivalent cations or monovalent cations, hybridization solutions etc. A diagnostic kit for the detection of PDE4D7 proteins may also comprise accessory ingredients like secondary affinity ligands, e.g. secondary antibodies, detection dyes and any other suitable compound or liquid necessary for the performance of a protein detection based known to the person skilled in the art. Such ingredients are known to the person skilled in the art and may vary depending on the detection method carried out. Additionally, the kit may comprise an instruction leaflet and/or may provide information as to the relevance of the obtained results.

In another aspect the present invention relates to a method for detecting, diagnosing, monitoring or prognosticating malignant, hormone-sensitive prostate cancer or the progression towards malignant, hormone-sensitive prostate cancer, e.g. in an individual, comprising at least the step of determining the level of PDE4D7 in a sample. The term "determining the level of PDE4D7" refers to the determination of the presence or amount of PDE4D7 expression products, e.g. PDE4D7 transcript(s), and/or the determination of the presence and/or amount of PDE4D7 protein(s). The term "level of PDE4D7" thus means the presence or amount of PDE4D7 expression products, e.g. PDE4D7 transcript(s), and/or the determination of the presence or amount of PDE4D7 protein(s). The determination of the presence or amount of PDE4D7 expression products, e.g. PDE4D7 transcript(s) or PDE4D7 protein(s) may be accomplished by any means known in the art.

In a preferred embodiment of the present invention the determination of the presence or amount of PDE4D7 expression products, e.g. PDE4D7 transcript(s) and/or of PDE4D7 protein(s), is accomplished by the measurement of nucleic acid or protein levels or by the determination of the biological activity of PDE4D7. Thus, the PDE4D7 expression level(s) may be determined by a method involving the detection of an mRNA encoded by the PDE4D7 gene, the detection of the PDE4D7 protein encoded by the PDE4D7 transcript and/or the detection of the biological activity of the PDE4D7 protein.

For example, the measurement of the nucleic acid level of PDE4D7 expression may be assessed by separation of nucleic acid molecules (e.g. RNA or cDNA) obtained from the sample in agarose or polyacrylamide gels, followed by hybridization with PDE4D7 specific oligonucleotide probes as defined herein above. Alternatively, the expression level may be determined by the labeling of nucleic acid obtained from the sample followed by separation on a sequencing gel. Nucleic acid samples may be placed on the gel such that patient and control or standard nucleic acid are in adjacent lanes. Comparison of expression levels may be accomplished visually or by means of a densitometer. Methods for the detection of mRNA or expression products are known to the person skilled in the art. Typically, Northern blot analysis may be used for such a purpose.

Alternatively, the nucleic acid level of PDE4D7 expression may be detected in a DNA array or microarray approach. Typically, sample nucleic acids derived from subjects to be tested are processed and labeled, preferably with a fluorescent label. Subsequently, such nucleic acid molecules may be used in a hybridization approach with immobilized capture probes corresponding to the PDE4D7 marker gene of the present invention or known biomarker or cancer marker genes. Suitable means for carrying out microarray analyses are known to the person skilled in the art.

In a standard setup a DNA array or microarray comprises immobilized high-density probes to detect a number of genes. The probes on the array are complementary to one or more parts of the sequence of the marker gene, or to the entire coding region of the marker gene. In the present invention, any type of PDE4D7 associated polynucleotide may be used as probe for the DNA array, as long as the polynucleotide allows for a specific distinction between PDE4D7 expression and the expression of other genes. Typically, cDNAs, PCR products, and oligonucleotides are useful as probes. Preferably, a probe involving the specific portions of splice variant 7 of PDE4D may be used as a probe. In addition to the determination of the PDE4D7 expression also the determination of the expression of other genes, e.g. additional biomarker or cancer marker genes may be accomplished.

A DNA array- or microarray-based detection method typically comprises the following steps: (1) Isolating mRNA from a sample and optionally converting the mRNA to cDNA, and subsequently labeling this RNA or cDNA. Methods for isolating RNA, converting it into cDNA and for labeling nucleic acids are described in manuals for micro array technology. (2) Hybridizing the nucleic acids from step 1 with probes for the marker genes. The nucleic acids from a sample can be labeled with a dye, such as the fluorescent dyes Cy3

(red) or Cy5 (blue). Generally a control sample is labeled with a different dye. (3) Detecting the hybridization of the nucleic acids from the sample with the probes and determining at least qualitatively, and more particularly quantitatively, the amounts of mRNA in the sample for PDE4D7 and/or additional marker genes investigated. The difference in the expression level between sample and control can be estimated based on a difference in the signal intensity. These can be measured and analyzed by appropriate software such as, but not limited to the software provided for example by Affymetrix.

There is no limitation on the number of probes corresponding to the marker genes used, which are spotted on a DNA array. Also, a marker gene can be represented by two or more probes, the probes hybridizing to different parts of a gene. Probes are designed for each selected marker gene. Such a probe is typically an oligonucleotide comprising 5-50 nucleotide residues. Longer DNAs can be synthesized by PCR or chemically. Methods for synthesizing such oligonucleotides and applying them on a substrate are well known in the field of micro-arrays. Genes other than the marker genes may be also spotted on the DNA array. For example, a probe for a gene whose expression level is not significantly altered may be spotted on the DNA array to normalize assay results or to compare assay results of multiple arrays or different assays.

Alternatively, the nucleic acid level of PDE4D7 expression may be detected in a quantitative RT-PCR approach, preferably in a real-time PCR approach following the reverse transcription of the PDE4D7 mRNA transcript. Typically, as first step, a transcript is reverse transcribed into a cDNA molecule according to any suitable method known to the person skilled in the art. A quantitative or real-time PCR approach may subsequently be carried out based on a first DNA strand obtained as described above.

Preferably, Taqman or Molecular Beacon probes as principal FRET-based probes of this type may be used for quantitative PCR detection. In both cases, the probes, preferably PDE4D7 probes as defined herein above, serve as internal probes which are used in conjunction with a pair of opposing primers that flank the target region of interest, preferably a set of PDE4D7 oligonucleotides as defined herein above. Upon amplification of a target segment, the probe may selectively bind to the products at an identifying sequence in between the primer sites, thereby causing increases in FRET signaling relative to increases in target frequency.

Preferably, a Taqman probe to be used for a quantitative PCR approach according to the present invention may comprises a PDE4D7 oligonucleotide as defined above of about 22 to 30 bases that is labeled on both ends with a FRET pair. Typically, the 5' end will have a shorter wavelength fluorophore such as fluorescein (e.g. FAM) and the 3' end is commonly labeled with a longer wavelength fluorescent quencher (e.g. TAMRA) or a non-fluorescent quencher compound (e.g. Black Hole Quencher). It is preferred that the probes to be used for quantitative PCR, in particular the PDE4D7 probes as defined herein above, have no guanine (G) at the 5' end adjacent to the reporter dye in order to avoid quenching of the reporter fluorescence after the probe is degraded.

A Molecular Beacon probe to be used for a quantitative PCR approach according to the present invention preferably uses FRET interactions to detect and quantify a PCR product, with each probe having a 5' fluorescent-labeled end and a 3' quencher-labeled end. This hairpin or stem-loop configuration of the probe structure comprises preferably a stem with two short self-binding ends and a loop with a long internal target-specific region of about 20 to 30 bases.

Alternative detection mechanisms which may also be employed in the context of the present invention are directed to a probe fabricated with only a loop structure and without a short complementary stem region. An alternative FRET-based approach for quantitative PCR which may also be used in the context of the present invention is based on the use of two hybridization probes that bind to adjacent sites on the target wherein the first probe has a fluorescent donor label at the 3' end and the second probe has a fluorescent acceptor label at its 5' end.

The measurement of protein levels of the PDE4D7 protein or of any fragments, homologues or derivates derived thereof may be carried out via any suitable detection technique known in the art. Preferably, the protein level of PDE4D7 and derivatives thereof may be determined immunologically, e.g. by using an antibody specific for the PDE4D7 protein, preferably an antibody as defined herein above. Alternatively, antibody variants or fragments as defined herein above may be used. The present invention also envisages the use of peptide affinity ligands like aptamers specific for the PDE4D7 protein as defined herein above.

Determination of the protein levels of the PDE4D7 protein can be accomplished, for example, by the separation of proteins from a sample on a polyacrylamide gel, followed by identification of the PDE4D7 protein using specifically binding antibodies in a Western blot analysis. Alternatively, proteins can be separated by two-dimensional gel electrophoresis systems. Two-dimensional gel electrophoresis is well known in the art and typically involves iso-electric focusing along a first dimension followed by SDS-PAGE electrophoresis along a second dimension. The analysis of 2D SDS-PAGE gels can be performed by determining the intensity of protein spots on the gel, or can be performed using immune detection. In other embodiments, protein samples are analyzed by mass spectroscopy.

Within the context of the present invention PDE4D7 specific antibodies may be placed on a support and be immobilized. Proteins derived from samples or tissues to be analyzed may subsequently be mixed with the antibodies. A detection reaction may then be carried out, e.g. with a second affinity ligand as defined herein above, preferably with a specific antibody.

Immunological tests which may be used in the context of the present invention, in particular for the diagnostic purposes of the present invention, include, for example, competitive and non-competitive assay systems using techniques such as western blots, radioimmunoassay like RIA (radio-linked immunoassay), ELISA (enzyme linked immunosorbent assay), "sandwich" immunoassays, immunoprecipitation assays, precipitin reactions, gel diffusion precipitin reactions, immunodiffusion assays, agglutination assays, e.g. latex agglutination, complement-fixation assays, immunoradiometric assays, fluorescent immunoassays, e.g. FIA (fluorescence-linked immunoassay), chemiluminescence immunoassays, electrochemiluminescence immunoassay (ECLIA) and protein A immunoassays. Such assays are routine and well known to the person skilled in the art.

Furthermore, the binding affinity of an antibody to an antigen and the off-rate of an antibody-antigen interaction may be determined by competitive binding assays. One example of a competitive binding assay is a radioimmunoassay comprising the incubation of labeled antigen (e.g., $^3$H or $^{125}$I) with a suitable antibody in the presence of increasing amounts of unlabeled antigen, and the detection of the antibody bound to the labeled antigen. The affinity of the antibody of interest for a particular antigen and the binding off-rates may be determined from the data by any suitable analysis approach, e.g. by a scatchard plot analysis. Competition with a second antibody may also be determined using radioimmunoassays. In this case, the antigen may be incubated with a suitable antibody conjugated to a labeled compound (e.g., $^3$H or $^{125}$I) in the presence of increasing amounts of an unlabeled second antibody.

In addition, aptamers specific for the PDE4D7 protein, preferably as defined herein above, may be used in a method of detecting PDE4D7 proteins. Such aptamers may preferably be labeled in order to allow the detection of a protein-ligand interaction.

The determination of the biological activity of PDE4D7 may be carried out by employing molecular or enzymatic assays specific to the corresponding function or functions of PDE4D7. Preferably, a readout system based on the conversion of cAMP by phosphodiesterase may be used. Suitable techniques would be known to the person skilled in the art. In a further preferred embodiment, an assay for the determination of the biological activity of PDE4D7 may be carried out in combination with the inhibition of the activity of other PDE4D splice variants, other PDE4 iso forms and/or other PDEs, preferably other PDEs capable of performing the conversion of cAMP. Such an inhibition of the activity may be carried out by any suitable means known to the person skilled in the art, preferably via the use of suitable antisense nucleotides, siRNA molecules or miRNA molecules, more preferably via specifically hybridizing antisense nucleotides, specific siRNA or miRNA molecules.

In a further preferred embodiment the biological activity of PDE4D7 may be tested with the help of specific PDE4D7 inhibitors. The use of such inhibitors may, for example, be combined with a readout system based on the conversion of the cAMP substrate. Typical PDE4D7 inhibitors to be used comprise antisense molecules, siRNA molecules or miRNA molecules.

The level of PDE4D7 may also be detected in methods involving histological or cell-biological procedures. Typically, visual techniques, such as light microscopy or immunofluoresence or UV microscopy, as well as flow cytometry or luminometry may be used. The presence of PDE4D7 protein in a cell may, for instance, be detected or determined by removing cells to be tested from samples as defined herein above. Also tissue sections or biopsy samples may be used for these methods. Subsequently, affinity ligands for PDE4D7 may be applied, preferably antibodies or aptamers. Typically, such affinity ligands are labeled, preferably with fluorescent labels as defined herein above. Such a procedure allows for the detection of PDE4D7, for its quantification and, in addition, allows to determine the distribution and relative level of expression thereof.

Such procedures involve the use of visualization methods. Suitable visualization methods are known to the person skilled in the art. Typical methods to be used comprise fluorometric, luminometric and/or enzymatic techniques. Fluorescence is normally detected and/or quantified by exposing fluorescent labels to light of a specific wavelength and thereafter detecting and/or quantifying the emitted light of a specific wavelength. The presence of a luminescently tagged affinity ligand may be detected and/or quantified by luminescence developed during a chemical reaction. Detection of an enzymatic reaction is due to a color shift in the sample arising from chemical reaction.

In a further, preferred embodiment the level of PDE4D7 may be determined by suitable molecular imaging techniques, e.g. magnetic resonance imaging (MRI) or magnetic photon imaging (MPI), and/or by using suitable contrast agents, e.g. contrast agents as defined herein above.

In a further, preferred embodiment a method for detecting, diagnosing, monitoring or prognosticating malignant, hormone-sensitive prostate cancer or the progression towards malignant, hormone-sensitive prostate cancer of the present invention comprises the additional step of comparing the measured nucleic acid or protein levels or the measured biological activity to a control level. The term "control level" as used herein refers to the expression of the PDE4D7 marker or other suitable markers in a normal control or cancerous control, as defined herein above. The status, nature, amount and condition of the control level may be adjusted according to the necessities. Preferably a healthy or benign control level may be used. The term "comparing" as used herein refers to any suitable method of assessing, calculating, evaluating or processing of data.

In yet another embodiment as a further, additional step a decision on the presence or stage of cancer or the progression of cancer may be based on the results of the comparison step. A malignant, hormone-sensitive prostate cancer may be diagnosed or prognosticated or a progression towards malignant, hormone-sensitive prostate cancer may be diagnosed or prognosticated in said method according to the corresponding definitions provided herein above in the context of PDE4D7 as marker for malignant, hormone-sensitive prostate cancer.

In another embodiment the present invention relates to a method for detecting, diagnosing, monitoring or prognosticating malignant, hormone-sensitive prostate cancer or the progression towards malignant, hormone-sensitive prostate cancer comprising at least the steps of:

(a) testing in at least one sample obtained from at least one individual suspected to suffer from malignant, hormone-sensitive prostate cancer for expression of the PDE4D7 expression product or the PDE4D7 protein;

(b) testing in at least one control sample obtained from at least one individual not suffering from malignant, hormone-sensitive prostate cancer for the expression of the PDE4D7 expression product or the PDE4D7 protein;

(c) determining the difference in the expression of steps (a) and (b); and (d) deciding on the presence or stage of malignant, hormone-sensitive prostate cancer or the progression towards malignant, hormone-sensitive prostate cancer based on the results obtained in step (c).

In one embodiment, steps a), b), c) and/or d) of this method of diagnosis may be performed outside the human or animal body, e.g. in samples obtained from a patient or individual.

In another aspect the present invention relates to a method for diagnosing, monitoring or prognosticating malignant, hormone-sensitive prostate cancer or the progression towards malignant, hormone-sensitive prostate cancer, wherein said method discriminates between a benign and a malignant, hormone-sensitive prostate cancer, comprising the steps of (a) determining the level of PDE4D7, (b) determining the level of expression of a reference gene in a sample;

(c) normalizing the measured expression level of PDE4D7 to the expression of the reference gene; and (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between −2 and +2, preferably about 0.

The level of PDE4D7 may be determined on the nucleic acid, protein or activity level as described herein above. Preferred is the determination of the amount of PDE4D7 transcript(s) and/or protein. In addition the level of a housekeeping gene in sample may be determined.

The term "reference gene" as used herein refers to any suitable gene, e.g. to any steadily expressed and continuously detectable gene, gene product, expression product, protein or protein variant in the organism of choice. The term also includes gene products such as expressed proteins, peptides, polypeptides, as well as modified variants thereof. The invention hence also includes reference proteins derived from a reference gene. Also encompassed are all kinds of transcripts derivable from the reference gene as well as modifications thereof or secondary parameters linked thereto. Alternatively or additionally, other reference parameters may also be used for reference purposes, e.g. metabolic concentrations, cell sizes etc.

The expression may be preferably be carried out in the same sample, i.e. the level of PDE4D7 and of the reference gene is determined in the same sample. If the testing is carried out in the same sample, a single detection or a multiplex detection approach as described herein may be performed. Preferably, for a multiplex detection the oligonucleotides and probes having the sequence of SEQ ID NO: 10, 11 and 12 may be used. For the performance of the multiplex detection the concentration of primers and/or probe oligonucleotides may be modified. Furthermore, the concentration and presence of further ingredients like buffers, ions etc. may be modified, e.g. increased or decreased in comparison to manufacturers' indications.

In a specific embodiment of the present invention, the expression of more than one reference gene or steadily expressed gene may be determined. E.g. the expression of 2, 3, 4, 5, 6, 7, 8, 9, 10, 12, 15, 20, 30 or more reference genes may be determined. The results of such measurements may be either calculated separately, or may be combined in order to obtain an average expression index. Furthermore, pattern of reference gene expression may be determined and/or used as basis for subsequent steps. Such pattern may be based on known expression behaviors of genes in certain cancer, in particular prostate cancer stages or states.

Furthermore, expression results may be compared to already known results from reference cases or databases. The comparison may additionally include a normalization procedure in order to improve the statistical relevance of the results.

In an alternative embodiment of the present invention, instead of determining the level of expression of a reference gene in a sample, the expression of a further cancer marker or non-steadily expressed gene may be determined. For example, the expression of a gene, which is known to be reduced during hormone-resistant prostate cancer, or which is known to be increased during hormone-sensitive prostate cancer, may be determined.

In a further embodiment, also both expression determinations may be carried out, i.e. the determination of expression of a reference gene and of a further cancer or biomarker gene.

Expression results may be normalized according to any suitable method known to the person skilled in the art, e.g. according to normalization statistical methods like the standard score, Student's T-test, studentized residual test, standardized moment text, or coeffizient variation test. Typically, such tests or corresponding formula, which would be known to the person skilled in the art, would be used to standardize expression data to enable differentiation between real variations in gene expression levels and variations due to the measurement processes.

Based on the expression results obtained in steps (a) and (b) and/or the normalized results obtained in step (c) a comparison with a cutoff value for PDE4D7 expression may be carried out. The cutoff value above which the expression level of PDE4D7 is indicative of a malignant, hormone-sensitive prostate cancer, thereby excluding benign prostate tumor forms or healthy situations or healthy tissue forms, is between about −3 and +3, −3 and +2.75, −3 and +2.5, −3 and +2.25, −3 and +2, −3 and +1.75, −3 and +1.5, −3 and +1.25, −3 and +1, −3 and +0.75, −3 and +0.5, −3 and +0.25, −3 and 0, −2.75 and +3, −2.5 and +3, −2.25 and +3, −2 and +3, −1.75 and +3, −1.5 and +3, −1.25 and +3, −1 and +3, −0.75 and +3, −0.5 and +3, −0.25 and +3, or 0 and +3. More preferred is a cutoff value of about 0, e.g. 0.9, 0.8, 0.7, 0.6, 0.5, 0.4, 0.3, 0.2, 0.1 or −0.9, −0.8, −0.7, −0.6, −0.5, −0.4, −0.3, −0.2, or −0.1. In a particularly preferred embodiment, said cutoff is to be used with a different phosphodiesterase as reference gene. Even more preferably, said cutoff is to be used with a PDE4D5 gene as reference gene.

In a preferred embodiment of the present invention the cutoff value is a cutoff value for PDE4D7 in blood samples, e.g. serum or plasma samples, urine samples or urine sediment samples. In a particularly preferred embodiment of the present invention the cutoff value is a cutoff value for the PDE4D7 protein or polypeptide or any derivative thereof as defined herein above in a urine sample. In another particularly preferred embodiment of the present invention the cutoff value is a cutoff value for the PDE4D7 protein or polypeptide or any derivative thereof as defined herein above in cells contained in urine or exosomes secreted from cells contained in urine. In an even more preferred embodiment of the present invention the cutoff value is a cutoff value for the PDE4D7 protein or polypeptide or any derivative thereof as defined herein above in a urine sediment sample and cells contained in a urine sediment sample, or exosomes secreted from cells contained in a urine sediment sample.

If the measured and/or normalized PDE4D7 expression is below the indicated cutoff value this may be seen as an indication that the individual is either healthy with respect to prostate tumors or suffers only from benign prostate tumors, but not from malignant, hormone-sensitive prostate cancer.

In another aspect the present invention relates to a method of data acquisition comprising at least the steps of:
(a) testing in an individual for expression of PDE4D7; and
(b) comparing the expression as determined in step (a) to a control level.

The testing for expression of PDE4D7 may be carried out according to steps as defined herein above. Preferably the testing may be carried out as measurement of nucleic acid or protein levels of PDE4D7 or by determining the biological activity of PDE4D7, more preferably according to the herein above described options for such measurements. The testing may be carried out in an individual, i.e. in vivo, or outside the individual, i.e. ex vivo or in vitro. The term "control level" as used in the context of the method of data acquisition refers to the expression of the PDE4D7 marker or other suitable markers in a normal control or a cancerous control, as defined herein above. The status, nature, amount and condition of the control level may be adjusted according to the necessities. Preferably a normal, healthy control level may be used. A comparison of the expression to a control level may be carried out according to any suitable method of assessing, calculating, evaluating or processing of data and particularly aims at the detection of differences between two data sets. A statistical evaluation of the significance of the difference may further be carried out. Suitable statistical methods are known to the person skilled in the art. Obtained data and information may be stored, accumulated or processed by suitable informatics or computer methods or tools known to the person skilled in the art and/or be presented in an appropriate manner in order to allow the practitioner to use the data for one or more subsequent deduction or conclusion steps.

In another aspect the present invention relates to an immunoassay for detecting, diagnosing, monitoring or prognosticating malignant, hormone-sensitive prostate cancer or the progression towards malignant, hormone-sensitive prostate cancer comprising at least the steps of:

(a) testing in a sample obtained from an individual for the expression of PDE4D7, (b) testing in a control sample for the expression of PDE4D7, (c) determining the difference in expression of PDE4D7 of steps (a) and (b); and (d) deciding on the presence or stage of malignant, hormone-sensitive prostate cancer or the progression towards malignant, hormone-sensitive prostate cancer based on the results obtained in step (c).

The immunoassay is preferably based on the use of an antibody specifically binding to PDE4D7, e.g. one or more of the PDE4D7 antibodies mentioned herein. Alternatively, the immunoassay may be carried out or combined with any other suitable agent. For example, the assay may be combined with the detection of nucleic acids, or enzymatic testing methods as described herein.

In a further aspect the present invention relates to an immunoassay for discriminating between a benign prostate tumor and a malignant, hormone-sensitive prostate cancer, comprising the steps of (a) determining the level of PDE4D7 in a sample;

(b) determining the level of expression of a reference gene in a sample;

(c) normalizing the measured expression level of PDE4D7 to the expression of the reference gene; and (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 and +2. Preferably, the cutoff value is about 0.

The level of PDE4D7 may preferably be determined on the protein or activity level as described herein above. Preferred is the determination of the amount of PDE4D7 protein with the help of PDE4D7 specific antibodies, e.g. one or more of the PDE4D7 antibodies mentioned herein. Alternatively, the immunoassay may be carried out with any other suitable agent or be combined with the determination of other entities. For example, the assay may be combined with the detection of the presence or amount of nucleic acids, or enzymatic testing methods as described herein.

In addition the level of a reference gene as defined herein above in a sample may be determined. For the detection of a reference gene the amount of the gene's expression product (i.e. protein) may be determined, preferably with the help of one or more suitable antibodies known to the person skilled in the art. Alternatively, the determination of the reference gene may be carried out with any other suitable agent or be combined with the detection of the presence or amount of nucleic acids, or enzymatic testing methods as described herein.

Based on the expression results obtained in steps (a) and (b) and/or the normalized results obtained in step (c) a comparison with a cutoff value for PDE4D7 expression may be carried out. The cutoff value above which the expression level of PDE4D7 is indicative of a malignant, hormone-sensitive prostate cancer, thereby excluding benign prostate tumor forms or healthy situations or healthy tissue forms, is between about −3 and +3, −3 and +2.75, −3 and +2.5, −3 and +2.25, −3 and +2, −3 and +1.75, −3 and +1.5, −3 and +1.25, −3 and +1, −3 and +0.75, −3 and +0.5, −3 and +0.25, −3 and 0, −2.75 and +3, −2.5 and +3, −2.25 and +3, −2 and +3, −1.75 and +3, −1.5 and +3, −1.25 and +3, −1 and +3, −0.75 and +3, −0.5 and +3, −0.25 and +3, or 0 and +3. More preferred is a cutoff value of about 0, e.g. 0.9, 0.8, 0.7, 0.6, 0.5, 0.4, 0.3, 0.2, 0.1 or −0.9, −0.8, −0.7, −0.6, −0.5, −0.4, −0.3, −0.2, or −0.1. In a particularly preferred embodiment, said cutoff is to be used with a different phosphodiesterase as reference gene. Even more preferably, said cutoff is to be used with a PDE4D5 gene as reference gene.

The cutoff value may be a cutoff value for PDE4D7 in blood samples, e.g. serum or plasma samples, urine samples or urine sediment samples etc. as described herein below.

If the measured and/or normalized PDE4D7 expression is below the indicated cutoff value this may be seen as an indication that the individual is either healthy with respect to prostate tumors or suffers only from benign prostate tumors, but not from malignant, hormone-sensitive prostate cancer. The value may additionally indicate that the individual suffers from a hormone-resistant prostate cancer. In order to investigate or exclude the presence of hormone-resistant cancer diseases, the level of further suitable biomarker may be tested, e.g. the level of PSA. In case of hormone-resistant prostate cancer a PSA level of >20 ng/ml is to be expected.

In a further aspect the present invention relates to a method of identifying an individual for eligibility for malignant, hormone-sensitive prostate cancer therapy comprising:

(a) testing in a sample obtained from an individual for the expression of PDE4D7;

(b) testing in said sample for the expression of a reference gene and/or testing in a control sample for the expression of PDE4D7;

(c) classifying the levels of expression of step (a) relative to levels of step (b); and (d) identifying the individual as eligible to receive a malignant, hormone-sensitive prostate cancer therapy where the individual's sample is classified as having an increased level of PDE4D7 expression.

The level of PDE4D7 may be determined on the nucleic acid, protein or activity level as described herein above. Preferred is the determination of the amount of PDE4D7 transcript(s) and/or protein. In addition the level of a reference gene as described herein above in a sample may be determined. Testing for the expression of a reference gene may be carried out in the same sample used for the determination of PDE4D7. If the testing is carried out in the same sample, a single detection or a multiplex detection approach may be performed. Preferably, for a multiplex detection the oligonucleotides and probes having the sequence of SEQ ID NO: 10, 11 and 12 may be used. For the performance of the multiplex detection the concentration of primers and/or probe oligonucleotides may be modified. Furthermore, the concentration and presence of further ingredients like buffers, ions etc. may be modified, e.g. increased or decreased in comparison to manufacturers' indications. Alternatively, the testing for the expression of a reference gene may be carried out in a different sample, preferably a control sample as defined herein above. Preferably, such a control sample may be a control sample from the same individual as the test sample, or a control sample derived from a different source or individual. The control sample may further be either a sample derived from the same tissue, preferably prostate tissue, or be derived from a different tissue type. Examples of preferred alternative tissue types are stromal prostate tissue, bladder epithelial tissue and urethra epithelial tissue. Furthermore, the testing of the test sample for the expression of a reference gene and the testing of control sample for the expression of PDE4D7 may be combined.

In a further embodiment the control sample may also be tested for the expression of the reference gene. In case more than one sample was tested for the expression of a reference gene, the obtained expression results may be compared and/or averaged or normalized according to any suitable statistical method known to the person skilled in the art.

The term "classifying the levels of expression of step (a) relative to levels of step (b)" as used herein means that the expression in a test sample for PDE4D7 and the expression in a control sample for PDE4D7 are compared, e.g. after normalization against a suitable normalization references. According to the outcome of the comparison the test sample is indicated as providing a similar expression as the control sample, an increased expression in comparison to the control sample, or an reduced expression in comparison to the control sample. The term further means that the expression in a test sample for PDE4D7 and the expression in the same test sample for a reference gene are compared, e.g. after normalization against a further gene as normalization reference. According to the outcome of the comparison the test sample is indicated as providing a similar expression as the reference gene, an increased expression in comparison to the reference gene, or an reduced expression in comparison to the reference gene.

According to the classification of the expression results an individual may be considered to be eligible for a malignant, hormone-sensitive prostate cancer therapy when the PDE4D7 expression levels are increased. The expression level is deemed to be "increased" when the PDE4D7 gene expression in the test sample is elevated by, for example, 5%, 6%, 7%, 8%, 9%, 10%, 15%, 20%, 25%, 30%, 40%, 50%, or more than 50% in comparison to the PDE4D7 expression in a control sample, or at least 0.1 fold, at least 0.2 fold, at least 1 fold, at least 2 fold, at least 5 fold, or at least 10 fold or more in comparison to the PDE4D7 expression in a control sample; or when the PDE4D7 gene expression is elevated by, for example, 5%, 6%, 7%, 8%, 9%, 10%, 15%, 20%, 25%, 30%, 40%, 50%, or more than 50% in comparison to the expression of a reference gene in a control sample, or at least 0.1 fold, at least 0.2 fold, at least 1 fold, at least 2 fold, at least 5 fold, or at least 10 fold or more elevated in comparison to the expression of a reference gene. In a specific embodiment, the expression of a reference gene may also be normalized or adjusted to the expression of additional genes or markers, e.g. housekeeping genes.

In a further aspect the present invention relates to an immunoassay for stratifying an individual or cohort of individuals with a malignant, hormone-sensitive prostate cancer disease comprising:

(a) testing in a sample obtained from an individual for the expression of PDE4D7;

(b) testing in said sample for the expression of a reference gene and/or testing in a control sample for the expression of PDE4D7;

(c) determining the difference in expression of PDE4D7 of step (a) and the expression of PDE4D7 and/or the reference gene in step (b); and (d) stratifying an individual or cohort of individuals to a malignant, hormone-sensitive prostate cancer therapy based on the results obtained in step (c), where the individual's sample has an increased level of PDE4D7 expression.

The testing of the expression of PDE4D7 may preferably be carried out via the determination of the amount of PDE4D7 protein or the determination of the PDE4D7 activity level as described herein above. Preferred is the determination of the amount of PDE4D7 protein with the help of PDE4D7 specific antibodies, e.g. one or more of the PDE4D7 antibodies mentioned herein. Alternatively, the immunoassay may be carried out with any other suitable agent or be combined with the determination of other entities. For example, the assay may be combined with the detection of the presence or amount of nucleic acids, or enzymatic testing methods as described herein. In addition the level of a reference gene as described herein above in a sample may be determined. Testing for the expression of a reference gene may be carried out in the same sample used for the determination of PDE4D7. If the testing is carried out in the same sample, a single detection or a parallel or multiplex detection approach may be performed. Preferably, for a parallel or multiplex detection differently labeled primary or secondary antibodies may be used.

Alternatively, the testing for the expression of a reference gene may be carried out in a different sample, preferably a control sample as defined herein above. Preferably, such a control sample may be a control sample from the same individual as the test sample, or a control sample derived from a different source or individual. The control sample may further be either a sample derived from the same tissue, preferably prostate tissue, or be derived from a different tissue type. Examples of preferred alternative tissue types are stromal prostate tissue, bladder epithelial tissue and urethra epithelial tissue. Furthermore, the testing of the test sample for the expression of a reference gene and the testing of control sample for the expression of PDE4D7 may be combined.

In a further embodiment the control sample may also be tested for the expression of the reference gene. In case more than one sample was tested for the expression of a reference gene, the obtained expression results may be compared and/or averaged or normalized according to any suitable statistical method known to the person skilled in the art.

The term "determining the difference in expression of PDE4D7 of step (a) and the expression of PDE4D7 and/or the reference gene in step (b)" as used herein means that the expression in a test sample for PDE4D7 and the expression in a control sample for PDE4D7 are compared, e.g. after normalization against a suitable normalization references. According to the outcome of the comparison the test sample is indicated as providing a similar expression as the control sample, an increased expression in comparison to the control sample, or an reduced expression in comparison to the control sample. The term further means that alternatively or additionally the expression in a test sample for PDE4D7 and the expression in the same test sample for a reference gene are compared, e.g. after normalization against a further gene as normalization reference. According to the outcome of the comparison the test sample is indicated as providing a similar expression as the reference gene, or a difference in the expression. The difference may be either an increased expression in comparison to the reference gene, or a reduced expression in comparison to the reference gene.

The term "stratifying an individual or cohort of individuals to prostate cancer therapy" as used herein means that an individual is identified as pertaining to a group of similar individuals, whose optimal therapy form is a prostate cancer therapy, preferably a therapy against hormone-resistant prostate cancer in accordance with the outcome of the expression test as described herein above, in particular in accordance with encountered difference in the PDE4D7 expression level and a reference gene or the PDE4D7 expression level in different samples. According to the determination of the expression difference an individual may be identified as pertaining to a group of similar individuals whose optimal therapy form is malignant, hormone-sensitive prostate cancer therapy when the PDE4D7 expression levels are increased. The expression level is deemed to be "increased" when the PDE4D7 gene expression in the test sample is elevated by, for example, 5%, 6%, 7%, 8%, 9%, 10%, 15%, 20%, 25%, 30%, 40%, 50%, or more than 50% in comparison to the PDE4D7 expression in a control sample, or at least 0.1 fold, at least 0.2 fold, at least 1 fold, at least 2 fold, at least 5 fold, or at least 10 fold or more in comparison to the PDE4D7 expression in a control sample; or when the PDE4D7 gene expression is elevated by, for example, 5%, 6%, 7%, 8%, 9%, 10%, 15%, 20%, 25%, 30%, 40%, 50%, or more than 50% in comparison to the expression of a reference gene in a control sample, or at least 0.1 fold, at least 0.2 fold, at least 1 fold, at least 2 fold, at least 5 fold, or at least 10 fold or more elevated in comparison to the expression of a reference gene. In a specific embodiment, the expression of a reference gene may also be normalized or adjusted to the expression of additional genes or markers, e.g. housekeeping genes.

An individual being considered to be eligible for a malignant, hormone-sensitive prostate cancer therapy or being stratified to a malignant, hormone-sensitive prostate cancer therapy as described herein above may receive any suitable therapeutic treatment for this prostate cancer form known to the person skilled the art. In particular, the term "malignant, hormone-sensitive prostate cancer therapy" as used herein refers to any suitable prostate cancer therapy known to the person skilled in the art, and preferably includes surgical castration by removal of the testes as the main organ of male sex hormone production, chemical castration by e.g., suppression of generation of androgens or by inhibition of the androgen receptor activity, cytotoxic, chemotherapy radiation therapy (External Beam Radiation Therapy, Brachytherapy), Cryotherapy, focal therapies like HIFU ablation (High Frequency Ultrasound ablation), or thermal ablation.

Typically, an individual considered to be eligible for malignant, hormone-sensitive prostate cancer therapy due to increased PDE4D7 expression may be deemed to be suffering from a hormone-sensitive prostate cancer or be prone to develop a hormone-sensitive prostate cancer in the future, e.g. within the next 1 to 24 months. A correspondingly identified or stratified individual may be treated with an inhibitory pharmaceutical composition according to the present invention, e.g. as defined herein below. In a further embodiment a correspondingly identified individual may be treated with an inhibitory pharmaceutical composition according to the present invention in combination with an additional cancer therapy. The term "additional cancer therapy" refers to any types of cancer therapy known to the person skilled in the art. Preferred are cancer therapy forms known for hormone-resistant prostate cancer. The term includes, for example, all suitable forms of chemotherapy, radiation therapy, surgery, antibody therapies etc.

Alternatively, a correspondingly identified or stratified individual may also be treated solely with one or more cancer therapies such as a chemotherapy, radiation therapy, surgery, antibody therapies etc. Preferred are cancer therapies typically used for prostate cancer, more preferred cancer therapies used for malignant, hormone-sensitive prostate cancer.

In a further embodiment of the present invention the classification method for eligibility or the immunoassay for stratification as described herein above may also be used for monitoring the treatment of an individual, e.g. an individual being classified as suffering from a malignant, hormone-sensitive prostate cancer. The monitoring process may be carried out as expression determination over a prolonged period of time, e.g. during or after treatment sessions, for 1, 2, 3, 4, 5, 6, 7, 8, 9, 10 weeks, 1, 2, 3, 4, 5, 6, 7, 8, 9, 10 months, or 1, 2, 3 or more years. The determination steps may be carried out in suitable intervals, e.g. every week, 2 weeks, 3 weeks, every month, 2 months, 3 months, 6 months, 12 months etc. In a further embodiment of the present invention any treatment scheme as mentioned herein above may be adjusted, e.g. enforced or attenuated, or altered in any suitable manner in correspondence with the results of the monitoring process.

The testing for expression of PDE4D7 may be carried out according to steps as defined herein above. Preferably, the testing may be carried out as measurement of protein levels of PDE4D7, more preferably according to the herein above described options for such measurements. As controls or control samples controls as defined herein above may be used. In a particularly preferred embodiment the testing steps may be based on the use of an antibody specifically binding to PDE4D7, e.g. a commercially available anti-PDE4D7 antibody like NB300-652 or GTX14629. A cancer may be diagnosed or prognosticated or a progression of cancer may be diagnosed or prognosticated in said immunoassay or an individual may be identified for eligibility for prostate cancer, or an individual or cohort of individuals may be stratified in an immunoassay according to the corresponding definitions provided herein above in the context of the PDE4D7 as cancer marker. Accordingly, said testing or determining of the expression of PDE4D7 may be accomplished, or may additionally be accomplished, by the measurement of nucleic acid or protein levels or by the determination of the biological activity of PDE4D7. Similar measurements may be carried out with respect to the reference gene.

In a particularly preferred embodiment of the present invention the reference gene is a housekeeping gene or a different phosphodiesterase. In human organisms, examples of "housekeeping genes" include inter alia β-actin, glyceraldehyde 3-phosphate dehydrogenase (GAPDH), porphobilinogen deanimase (PBGD), and ribosomal protein P1. Apart from these genes any other suitable gene may be used as a house-keeping gene, as long as the gene shows an expression or transcription on a steady, non-modified level, in particular during different stages of cancer development, more preferably during different stages of prostate cancer development, more preferably during the transition of hormone-sensitive prostate cancer to hormone-resistant prostate cancer states. Particularly preferred is the gene or transcript or expression product or protein of GAPDH. Further particularly preferred is the gene or transcript or expression product or protein of PBGD. Expression data of a house-keeping gene may be obtained from one or more samples of the same individual or from more individuals, e.g. 2, 3, 4, 5, 6, 7, 8, 9, 10, 20, 50, 100, 1000, 5.000, 10.000 or more. Expression data may also be obtained from databases or from data collections available to the person skilled in the art.

The term "different phosphodiesterase" as used herein refers to other phosphodiesterases which are not PDE4D7. Such phosphodiestersases, to be suitable as reference genes, should be steadily expressed and provide a continuously detectable gene product, expression product, protein or protein variant in the organism of choice. Particularly preferred are phosphodiesterases of the PDE4D family, e.g. PDE4D1, PDE4D2, PDE4D3, PDE4D4, PDE4D5, PDE4D6, PDE4D8 and PDE4D9. More preferred is the PDE4D5 phosphodiesterase. Accordingly normalization and/or comparison with GAPDH, PBGD and in particular PDE4D5 may preferably be used for the above described cutoff based diagnosis methods and immunoassays, the methods of identifying or the immunoassays for discriminating or stratifying individuals. Corresponding determination steps may either be carried out in separate reactions, or, particularly preferred in multiplex reactions. For the performance of the multiplex detection the concentration of primers and/or probe oligonucleotides may be modified. Furthermore, the concentration and presence of further ingredients like buffers, ions etc. may be modified, e.g. increased or decreased in comparison to manufacturers' indications.

In a further embodiment of the present invention the method of identifying an individual for eligibility for malignant, hormone-sensitive prostate cancer therapy based on the expression of PDE4D7 as described herein above may further be combined with one or more similar identification methods, based on the expression of one or more different biomarkers. Preferred is the determination of the level of prostate specific antigen (PSA) in blood. Thus, if the level of PSA in blood is encountered to be of a ranger of about 2 to 5 or more ng/ml, preferably of about 2.2 to 4.8 ng/ml or more, 2.4 to 4.4 ng/ml or more, 2.6 to 4.2 ng/ml ore more or 2.8 to 4.0 ng/ml or more, more preferably of about 2.5 to 4 ng/ml or more, an individual may be considered to be suffering from malignant hormone-sensitive prostate cancer, or be likely to develop malignant hormone-sensitive prostate cancer in the near future, i.e. within the next 1, 2, 3, 4, 5, 6, 12, 14, 48 months. The testing for expression of PDE4D7 may be carried out according to steps as defined herein above. Preferably, the testing may be carried out as measurement of protein levels of PDE4D7, more preferably according to the herein above described options for such measurements. As controls or control samples controls as defined herein above may be used. In a particularly preferred embodiment the testing steps may be based on the use of an antibody specifically binding to PDE4D7, e.g. an antibody as defined herein above or a commercially available anti-PDE4D7 antibody like NB300-652 or GTX14629. A malignant, hormone-sensitive prostate cancer may be diagnosed or prognosticated or a progression towards malignant, hormone-sensitive prostate cancer may be diagnosed or prognosticated in said immunoassay according to the corresponding definitions provided herein above in the context of the PDE4D7 as marker for malignant, hormone-sensitive prostate cancer.

In a preferred embodiment of the present invention the diagnosing, detecting, monitoring or prognosticating as mentioned above is to be carried out on a sample obtained from an individual. The term "sample obtained from an individual" as used herein relates to any biological material obtained via suitable methods known to the person skilled in the art from an individual. The sample used in the context of the present invention should preferably be collected in a clinically acceptable manner, more preferably in a way that nucleic acids (in particular RNA) or proteins are preserved.

The biological samples may include body tissues and fluids, such as blood, sweat, sputum or saliva, semen and urine, as well as feces or stool samples. Furthermore, the biological sample may contain a cell extract derived from or a cell population including an epithelial cell, preferably a cancerous epithelial cell or an epithelial cell derived from tissue suspected to be cancerous. Even more preferably the biological sample may contain a cell population derived from a glandular tissue, e.g. the sample may be derived from the prostate of a male individual. Additionally, cells may be purified from obtained body tissues and fluids if necessary, and then used as the biological sample.

Samples, in particular after initial processing, may be pooled. However, also non-pooled samples may be used.

In a specific embodiment of the present invention the content of a biological sample may also be submitted to an enrichment step. For instance, a sample may be contacted with ligands specific for the cell membrane or organelles of certain cell types, e.g. prostate cells, functionalized for example with magnetic particles. The material concentrated by the magnetic particles may subsequently be used for detection and analysis steps as described herein above or below.

In a specific embodiment of the invention, biopsy or resections samples may be obtained and/or used. Such samples may comprise cells or cell lysates.

Furthermore, cells, e.g. tumor cells, may be enriched via filtration processes of fluid or liquid samples, e.g. blood, urine, sweat etc. Such filtration processes may also be combined with enrichment steps based on ligand specific interactions as described herein above.

In a particularly preferred embodiment of the present invention a sample may be a tissue sample, a biopsy sample, a urine sample, a urine sediment sample, a blood sample, a saliva sample, a semen sample, a sample comprising circulating tumor cells, or a sample containing prostate secreted exosomes. A blood sample, may, for example, be a serum sample or a plasma sample.

In yet another aspect the present invention relates to an inhibitory pharmaceutical composition comprising at least one element selected from the group consisting of: (a) a compound directly inhibiting the activity of PDE4D7, preferably an antagonist of PDE4D7 enzymatic activity; (b) a compound indirectly inhibiting the activity of PDE4D7; (c) a dominant negative form of the PDE4D7 protein or a biologically active equivalent thereof; (d) a nucleic acid encoding and expressing a dominant negative form of PDE4D7; (e) a miRNA specific for PDE4D7; (f) a PDE4D7 antisense molecule; (g) a siRNA specific for PDE4D7; (h) an aptamer specific for the PDE4D7 expression product or for the PDE4D7 protein; (i) a small molecule or peptidomimetic capable of specifically binding to the PDE4D7 protein; and (j) an antibody specific for the PDE4D7 protein and/or an antibody variant specific for the PDE4D7 protein.

The term "a compound directly inhibiting the activity of PDE4D7" as used herein refers to a compound which is capable of decreasing the activity of PDE4D7. Such a compound may be any direct interactor of PDE4D7, which has negative influence on the catalytic activity of PDE4D7. Such a compound may preferably be an antagonist of the catalytic activity of PDE4D7.

The term "a compound indirectly inhibiting the activity of PDE4D7" as used herein refers to a compound which is capable of decreasing the activity of PDE4D7 by an interaction with a direct interactor of PDE4D7 ("indirect interactor") or via an indirectly working pathway not involving an interaction with PDE4D7. Such a compound may be any direct interactor of an interactor of PDE4D7. The effect conveyed by the direct interactor of an interactor of PDE4D7 may be either negative if the interactor of itself has a negative effect on the activity of PDE4D7, or negative, if the interactor PDE4D7 has a positive effect on the activity of PDE4D7.

Particularly preferred are inhibitors of phosphodiesterases, in particular PDE4, more specifically of PDE4D, even more specifically of PDE4D7. Examples of suitable phosphodiesterase inhibitors which may singularly or in any combination be included in an inhibitory pharmaceutical composition according to the present invention are: Roflumilast, Piclamilast, Awd12-281, Ariflo, Sch351591, Cilomilast, Rolipram, Ro 20-1724, Etazolat, Hydrochloride, CP80633, IC163197, Irsogladin maleat, mesopram, YM976, Sch35159, V11294a, Arofylline, Denbufylline and Phosphodiesterase 4 Inhibitor. Further examples of suitable inhibitors are known to the person skilled in the art and are also envisaged by the present invention. Details on the structure, effectivity, suitable formulations etc. of the inhibitors would also be known to the person skilled in the art and/or can be derived from suitable text books or publications, e.g. Joseph A. Beavo, Sharron H. Francis, Miles D Houslay, Cyclic Nucleotide Phosphodiesterase in Health and Disease, CRC Press 2006.

Particularly preferred in the context of inhibitory pharmaceutical compositions are the following inhibitor compounds: Rolipram, Ro 20-1724, CP80633, ICI63197, YM976, Sch35159, and Phosphodiesterase 4 Inhibitor.

Rolipram is a selective full inhibitor of cAMP phosphodiesterase (PDE4) with an IC50 of 2.0 µM). Rolipram discriminates between two conformational states of PDE4 isoenzymes.

Ro 20-1724 is a widely used inhibitor of cyclic nucleotide phosphodiesterase, selective for PDE4 with an IC50 of 2.0 µM.

CP80633 is a selective inhibitor of phosphodiesterase type 4 with IC50 values of 1.9, >100, >100, >100 and >100 µM for human lung PDE4, lung PDE1, lung PDE2, heart PDE3 and platelet PDE-V respectively. CP80633 displays no significant PDE4 isozyme selectivity. CP80633 inhibits hydrolysis of cAMP in isolated human peripheral blood monocytes, eosinophils and T cells and displays anti-inflammatory and bronchodilatory effects in vivo.

ICI63197 is a potent phosphodiesterase (PDE) 4 inhibitor with an IC50 of 35 nM (for inhibition of [3H]-rolipram binding to rat brain).

YM976 is an orally active PDE4 inhibitor with an IC50 of 2.2 nM). It shows low emetogenic activity, suggested to be due to poor brain penetration.

Phosphodiesterase 4 Inhibitor is a pyrazole compound that acts as a high-affinity active site binding inhibitor of phosphodiesterases IVB and IVD with an IC50 of 33 nM and 21 nM, respectively. It is shown to be much more potent than Rolipram for PDEIVB and PDEIVD (with IC50=570 nM and 1.1 µM, respectively), and displays greater selectivity over PDEIB, PDEIIA, PDEIIIB, PDEVA, PDEVIIB, PDEVIIIA, PDEIXA and PDEXIA (IC50>30 µM) and minimally inhibits PDEXA with an IC50 of 6.9 µM.

The inhibitor compounds as defined above may be formulated, dosed, used or administered according to the herein provided details. In particular, the following Table of inhibitors may be used for the determination of necessary concentrations, formulations, adjuvcants etc.:
Table of Inhibitors:

| Compound | IC 50 | Manufacturer |
|---|---|---|
| Rolipram | 1 µM | Calbiochem |
| Ro 20-1724 | 2 µM | Calbiochem |
| CP80633 | 1.9 µM | Tocris |
| ICI63197 | 35 nM | Tocris |
| YM976 | 2.2 nM | Tocris |
| Phosphodiesterase 4 Inhibitor | 33 nM | Calbiochem |

Alternatively, such negatively working indirect integrators may provoke a modification of the binding behavior of directly binding proteins, leading to a decreased activity of PDE4D7. Typically negatively working indirect interactors may have an inhibitory effect on activators of PDE4D7. Examples of such interactors are enzymatic activities degrading activators of PDE4D7, or proteins capable of binding and quenching activators of PDE4D7. Alternatively, such interactors may positively modulate activities leading to a degradation of PDE4D7, e.g. proteinases. Further examples and their implementation would be known to the person skilled in the art.

Alternatively, an indirect inhibition of the activity of PDE4D7 may be conveyed by compounds deactivating, interfering or disrupting the expression of the endogenous gene(s) of PDE4D7. Examples of such compounds are specific interactors of transcription factors of PDE4D7 that inhibit and/or preclude binding of transcription factors and the basal transcription machinery to the promoters of the PDE4D7 gene, specific destabilizing activities of the mRNA(s) of PDE4D7 or factors inhibiting the splicing factors specific for PDE4D7. Further examples and their implementation would be known to the person skilled in the art.

A "nucleic acid encoding and expressing a dominant negative form of a protein of a tumor marker" as used herein refers to any nucleic acid capable of expressing a mutant form of a naturally occurring protein or polypeptide. Thus the term refers to a nucleic acid encoding (a) variant(s) of PDE4D7, which comprises an antimorphic modification, in particular which adversely affects PDE4D7. Typically, such a behavior may occur if the antimorphic variant can interact with PDE4D7 but blocks some aspect of its function. Preferably, such variants may comprise or lack specific domains of PDE4D7, e.g. one or more protein-protein interacting or dimerization domains, complex assembly domains, one or more membrane-associated domains etc.

The term "miRNA specific for PDE4D7" refers to a short single-stranded RNA molecule of typically 18-27 nucleotides in length, which regulate gene expression of PDE4D7. miRNAs are encoded by genes from whose DNA they are transcribed but are not translated into a protein. In a natural context miRNAs are first transcribed as primary transcripts or pri-miRNA with a cap and poly-A tail and processed to short, 70-nucleotide stem-loop structures known as pre-miRNA in the cell nucleus. This processing is performed in animals by a protein complex known as the Microprocessor complex, consisting of the nuclease Drosha and the double-stranded RNA binding protein Pasha. These pre-miRNAs are then processed to mature miRNAs in the cytoplasm by interaction with the endonuclease Dicer, which also initiates the formation of the RNA-induced silencing complex (RISC). After integration into an active RISC complex, miRNAs may base pair with their complementary mRNA molecules and inhibit translation or may induce mRNA degradation by the catalytically active members of the RISC complex, e.g. argonaute proteins. Mature miRNA molecules are typically at least partially complementary to mRNA molecules corresponding to the expression product of the present invention, and fully or partially down-regulate gene expression. Preferably, miRNAs according to the present invention may be 100% complementary to their target sequences. Alternatively, they may have 1, 2 or 3 mismatches, e.g. at the terminal residues or in the central portion of the molecule. miRNA molecules according to the present invention may have a length of between about 18 to 27 nucleotides, e.g. 18, 19, 20, 21, 22, 23, 24, 25, 26 or 27 nucleotides. Preferred are 21 to 23 mers.

miRNAs having 100% complementarity may preferably be used for the degradation of nucleic acids according to the present invention, whereas miRNAs showing less than 100% complementarity may preferably be used for the blocking of translational processes.

The term "PDE4D7 antisense molecule" refers to nucleic acids corresponding to the sequences comprised in SEQ ID NO: 1 or 6 or the complementary strand thereof. Preferably, the antisense molecule of the invention comprises a sequence complementary to at least a portion of a PDE4D7 expression product according to the present invention. While antisense molecules complementary to the coding region sequence of PDE4D7 may be used, those complementary to the transcribed and untranslated region are preferred.

Generally, antisense technology can be used to control, i.e. reduce or terminate gene expression through antisense DNA or RNA, or through triple-helix formation. In one embodiment, an antisense molecule may be generated internally by the organism, for example intracellularly by transcription from an exogenous sequence. A vector or a portion thereof may be transcribed, producing an antisense nucleic acid of the invention. Such a vector would contain a sequence encoding the antisense nucleic acid of the invention. Such a vector can remain episomal or become chromosomally integrated, as long as it can be transcribed to produce the desired antisense molecule. Corresponding vectors can be constructed by recombinant DNA technology methods known to the person skilled in the art. Vectors can be plasmid, viral, or others known in the art, used for replication and expression in vertebrate cells, e.g. vectors as defined herein above.

In another embodiment, the antisense molecule may be separately administered. As an example, the 5' coding portion of a PDE4D7 nucleic acid according to the present invention may be used to design an antisense RNA or DNA oligonucleotide of from about 6 to 50 nucleotides in length. Preferably, the oligonucleotide is at least 10 nucleotides, at least 17 nucleotides, at least 25 nucleotides or at least 50 nucleotides in length.

The antisense nucleic acids of the invention typically comprise a sequence complementary to at least a portion of an RNA transcript of a gene of interest. However, absolute complementarity, although preferred, is not required. A sequence "complementary to at least a portion of an RNA transcript" as referred to herein, means a sequence having sufficient complementarity to be able to hybridize with the RNA, forming a stable duplex triplex formation in the case of double stranded antisense nucleic acids. The ability to hybridize will depend on both the degree of complementarity and the length of the antisense nucleic acid. Generally, the larger the hybridizing nucleic acid, the more base mismatches with a RNA sequence of the invention it may contain and still form a stable duplex or triplex. A person skilled in the art can ascertain a tolerable degree of mismatch by use of standard procedures to determine the melting point of the hybridized complex.

Preferably antisense molecules complementary to the 5' end of the transcript, e.g., the 5' untranslated sequence up to and including the AUG initiation codon may be used in for the inhibition of translation. In a further preferred embodiment, sequences complementary to the 3' untranslated sequences of mRNAs may also be used.

An antisense molecule according to the present invention may be DNA or RNA or chimeric mixtures or derivatives or modified versions thereof, single-stranded or double-stranded. An antisense molecule, preferably an antisense olignucleotide or any further antisense nucleic acid molecule according to the present invention or a siRNA molecule according to the present invention can be modified at the base moiety, sugar moiety, or phosphate backbone, for example, to improve stability of the molecule, hybridization, etc. The molecule may include other appended groups such as peptides (e. g., for targeting host cell receptors in vivo), or agents facilitating transport across the cell membrane or the blood-brain barrier hybridization triggered cleavage agents or intercalating agents. The molecule may accordingly be conjugated to another molecule, e. g., a peptide, hybridization triggered cross-linking agent, transport agent, hybridization-triggered cleavage agent, etc.

The antisense molecule or antisense oligonucleotide, miRNA- or siRNA molecule, may comprise at least one modified base moiety which is selected from the group including 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethyl-aminomethyl-2-thiouridine, 5-carboxymethylaminomethyluracil, dihydrouracil, beta-D-galactosylqueosine, inosine, N6-isopentenyladenine, 1-methylguanine, 1-methylino sine, 2,2-dimethylguanine, 2-methyladenine, 2-methyl guanine, 3-methyl cytosine, 5-methylcytosine, N6-adenine, 7-methyl guanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6isopentenyladenine, uracil-5-oxyacetic acid, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid, 5-methyl-2-thiouracil, 3-(3-amino-3-N-2-carboxypropyl)uracil, and 2,6-diaminopurine. The molecule may also comprise at least one modified sugar moiety selected from the group including, but not limited to, arabinose, 2-fluoroarabinose, xylulose, and hexose. In another embodiment, the molecule comprises alternatively or additionally at least one modified phosphate backbone, e.g. a phosphorothioate, a phosphorodithioate, a phosphoramidothioate, a phosphoramidate, a phosphordiamidate, a methylphosphonate, an alkyl phosphotriester, and a formacetal or analog thereof.

In another embodiment, the antisense molecule, e.g. the antisense oligonucleotide may be an alpha-anomeric oligonucleotide, i.e. an oligonucleotide which forms specific double-stranded hybrids with complementary RNA in which the strands run parallel to each other.

The term "siRNA specific for PDE4D7" refers to a particular type of antisense-molecules, namely small inhibitory RNA duplexes that induce the RNA interference (RNAi) pathway to negatively regulate gene expression of the tumor marker according to Table 1. These siRNA molecules can vary in length and may be between about 18-28 nucleotides in length, e.g. have a length of 18, 19, 20, 21, 22, 23, 24, 25, 26, 27 or 28 nucleotides. Preferably, the molecule has a length of 21, 22 or 23 nucleotides. The siRNA molecule according to the present invention may contain varying degrees of complementarity to their target mRNA, preferably in the antisense strand. siRNAs may have unpaired overhanging bases on the 5' or 3' end of the sense strand and/or the antisense strand. The term "siRNA" includes duplexes of two separate strands, as well as single strands that can form hairpin structures comprising a duplex region. Preferably the siRNA may be double-stranded wherein the double-stranded siRNA molecule comprises a first and a second strand, each strand of the siRNA molecule is about 18 to about 23 nucleotides in length, the first strand of the siRNA molecule comprises nucleotide sequence having sufficient complementarity to the target RNA via RNA interference, and the second strand of said siRNA molecule comprises nucleotide sequence that is complementary to the first strand.

Methods for designing suitable siRNAs directed to a given target nucleic acid are known to person skilled in the art.

The term "aptamer specific for the expression product or specific for the protein of PDE4D7" as used herein refers to (a) short peptide(s) capable of interacting and specifically binding the PDE4D7 protein(s). The peptide aptamer(s) may preferably be able to specifically bind to (a) protein(s) or polypeptide(s) comprising (the) amino acid sequence as set forth in SEQ ID NO: 2. The peptide aptamer(s) may also be able to specifically bind to (a) protein(s) or polypeptide(s) comprising (an) amino acid sequence(s) encoded by (a) DNA sequence(s) being at least 75%, 80%, 85%, 90%, 91%, 92%, 93%, 94%, 95%, 96%, 97%, 98% or 99% identical to the sequence as set forth in SEQ ID NOs: 2 or to a protein or polypeptide comprising an amino acid sequence being at least 75%, 80%, 85%, 90%, 91%, 92%, 93%, 94%, 95%, 96%, 97%, 98% or 99% identical to the sequence as set forth in SEQ ID NO: 2. Typically, (a) peptide aptamer(s) is/are a variable peptide loop, comprising for example, 10 to 20 amino acids. In the context of the present invention the peptide aptamer(s) may preferably be attached at one or both ends to a scaffold structure. The scaffold structure may be any molecule, preferably a protein, which has good solubility properties. Suitable scaffold molecules would be known to the person skilled in the art. A preferred scaffold molecule to be used in the context of the present invention is the bacterial protein thioredoxin-A. The aptamer peptide loop may preferably be inserted within a reducing active site of the scaffold molecule. Alternatively, staphylococcal protein A and domains thereof and derivatives of these domains, such as protein Z or lipocalins may be used as scaffold structures in the context of the present invention. Peptide aptamers may be generated according to any suitable method known to the person skilled in the art, e.g. via yeast two-hybrid approaches.

In a preferred embodiment the above mentioned peptide aptamer is capable to bind to a PDE4D7 protein or polypeptide, preferably protein or polypeptide corresponding to SEQ ID NO: 2 and to reduce the biological activity and/or the enzymatic activity of these/this protein(s) by at least 10%, 20%, 30%, 40%, 50%, 60%, 70%, 80%, 90%, 95% or by at least 98% or 99% when compared to a control level obtained from an untreated sample.

A "small molecule capable of specifically binding to the PDE4DE7 protein" as used herein refers to a small organic compound that is preferably biologically active, i.e. a biomolecule, but is preferably not a polymer. Such an organic compound may have any suitable form or chemical property. The compound may be a natural compound, e.g. a secondary metabolites or an artificial compound, which has been designed and generated de novo. In an embodiment of the present invention a small molecule is capable of blocking the interaction between PDE, in particular PDE4D7, and its interactor. Methods and techniques for the identification and preparation of small molecules as well as assays for the testing of small molecules are known to the person skilled in the art.

The term "peptidomimetic capable of specifically binding to the PDE4D7 protein" in the context of the present invention refers to a small protein-like chain designed to mimic a peptide and capable of binding to the PDE4D7 protein. Such a peptidomimetic may arise from a modification of an existing peptide, e.g. a peptide or peptide aptamer as defined herein above, in order to alter the molecule's properties. A peptidomimetic may arise from a modification which changes the molecule's stability or binding capability. These modifications typically involve changes to the peptide that will not occur naturally. For example, a peptidomimetic according to the present invention may have altered peptide backbones or may comprise non-natural amino acids. Preferably, a peptidomimetic according to the present invention may represent a phosphodiesterase molecule, in particular PDE4D7, or an interacting or sequestering protein. In an embodiment of the present invention a peptidomimetic may block the interaction between PDE, in particular PDE4D7, and its interactor. Methods and techniques for the preparation of peptidomimetics as well as assays for the testing of peptidomimetics are known to the person skilled in the art.

An inhibitory pharmaceutical composition according to the present invention may also comprise an antibody specific for the PDE4D7 protein and/or an antibody variant specific for the PDE4D7 protein, e.g. an antibody or antibody variant as defined herein above.

In a preferred embodiment such an antibody or antibody fragment may be capable of inhibiting the biological activity and/or enzymatic activity of PDE4D7.

The skilled person would also be aware of the possibility to target and destroy malignant, hormone-sensitive prostate cancer cells and tissue by virtue of conjugated antibodies specific for PDE4D7. Thus, in a specific embodiment of the present invention the antibody or fragment thereof as defined herein above may be conjugated to a therapeutic or cytotoxic agent. The term "therapeutic agent" refers to any compound, drug, small molecule or medicament, which is able to confer a therapeutic effect to a cell, a tissue or the entire organism. Examples of such agents are known to the person skilled in the art. The term "cytotoxic agent" refers to any compound, drug, small molecule which is able to confer a toxic effect to a cell or a tissue. Such agents may, for example, comprise compounds which activate endogenous cytotoxic effector systems, as well as radioisotopes, holotoxins, modified toxins, catalytic subunits of toxins, or any molecules or enzymes not normally present in or on the surface of a cell that under defined conditions cause the cell's death. The term may also include radioisotopes known in the art, additional antibodies (or complement fixing containing portions thereof) that bind an inherent or induced endogenous cytotoxic effector system, thymidine kinase, endonuclease, RNAse, alpha toxin, ricin, abrin, *Pseudomonas* exotoxin A, diphtheria toxin, saporin, momordin, gelonin, pokeweed antiviral protein, alpha-sarcin and cholera toxin. The term also refers to cytotoxic produgs. By "cytotoxic prodrug" is meant a non-toxic compound that is converted by an enzyme, normally present in the cell, into a cytotoxic compound. Cytotoxic prodrugs that may be used according to the invention include glutamyl derivatives of benzoic acid mustard alkylating agent, phosphate derivatives of etoposide or mitomycin C, cytosine arabinoside, daunorubisin, and phenoxyacetamide derivatives of doxorubicin.

In an embodiment of the invention the pharmaceutical composition may further comprise additional compounds being active against cancer cells. Furthermore, in another embodiment of the invention the pharmaceutical composition may further comprise hormone-inhibitors, preferably anti-androgens or androgen antagonists like spironolactone, cyproterone acetate, flutamide, nilutamide, bicalutamide, ketoconazole, finasteride or dutasteride.

In a further embodiment the present invention also envisages screening procedures and methods for the identification of an aptamer specific for the PDE4D7 expression product or protein, a compound directly inhibiting the activity of PDE4D7, an antagonist of PDE4D7 enzymatic activity, a compound indirectly inhibiting the activity of PDE4D7; a dominant negative form of the PDE4D7 protein or a biologically active equivalent thereof; a miRNA specific for PDE4D7; a PDE4D7 antisense molecule; a siRNA specific for PDE4D7 and a small molecule or peptidomimetic capable of specifically binding to the PDE4D7 protein as described herein above. Such screening procedures may comprise the steps of (a) producing cells which express the PDE4D7 as a polypeptide either as secreted protein or on the cell membrane or as intracellular component, (b) contacting the polypeptide produced in step (a) with a test sample potentially containing an interacting molecule, e.g. an aptamer specific for the PDE4D7 expression product or protein, a compound directly inhibiting the activity of PDE4D7, an antagonist of PDE4D7 enzymatic activity, a compound indirectly inhibiting the activity of PDE4D7; a dominant negative form of the PDE4D7 protein or a biologically active equivalent thereof; a miRNA specific for PDE4D7; a PDE4D7 antisense molecule; a siRNA specific for PDE4D7 or a small molecule or peptidomimetic capable of specifically binding to the PDE4D7 and (c) identifying an interacting molecule by observing binding and/or inhibition or modulation of the activity of PDE4D7.

Alternatively, such screening procedures may comprise the steps of (a) contacting a test sample potentially containing a directly or indirectly interacting molecule, e.g. an aptamer specific for the PDE4D7 expression product or protein, a compound directly inhibiting the activity of PDE4D7, an antagonist of PDE4D7 enzymatic activity, a compound indirectly inhibiting the activity of PDE4D7; a dominant negative form of the PDE4D7 protein or a biologically active equivalent thereof; a miRNA specific for PDE4D7; a PDE4D7 antisense molecule; a siRNA specific for PDE4D7 and a small molecule or peptidomimetic capable of specifically binding to the PDE4D7 with one or more cells which express the PDE4D7 as a transcript, (b) detecting the expression level of said sequence; and (c) identifying an interacting molecule by observing binding or a modulation or reduction of the expression level of PDE4D7.

The present invention also encompasses an aptamer specific for the PDE4D7 expression product or protein, a compound directly inhibiting the activity of PDE4D7, an antagonist of PDE4D7 enzymatic activity, a compound indirectly inhibiting the activity of PDE4D7; a dominant negative form of the PDE4D7 protein or a biologically active equivalent thereof; a miRNA specific for PDE4D7; a PDE4D7 antisense molecule; a siRNA specific for PDE4D7 and a small molecule or peptidomimetic capable of specifically binding to the PDE4D7 obtainable or obtained by a screening procedure or method as described herein above.

In a further aspect the present invention relates to an inhibitory pharmaceutical composition as defined herein above for the treatment or prevention of malignant, hormone-sensitive prostate cancer.

Further, in yet another aspect, the present invention relates to the use of (a) a compound directly inhibiting the activity of PDE4D7, preferably an antagonist of PDE4D7 enzymatic activity; (b) a compound indirectly inhibiting the activity of PDE4D7; (c) a dominant negative form of the PDE4D7 protein or a biologically active equivalent thereof; (d) a nucleic acid encoding and expressing a dominant negative form of PDE4D7; (e) a miRNA specific for PDE4D7; (f) a PDE4D7 antisense molecule; (g) a siRNA specific for PDE4D7; (h) an aptamer specific for the PDE4D7 expression product or for the PDE4D7 protein; (i) a small molecule or peptidomimetic capable of specifically binding to the PDE4D7 protein; and/or (j) an antibody specific for the PDE4D7 protein and/or an antibody variant specific for the PDE4D7 protein for the preparation of an inhibitory pharmaceutical composition for the treatment or prevention of malignant, hormone-sensitive prostate cancer.

In another aspect the present invention relates to a method of treatment or prevention of malignant, hormone-sensitive prostate cancer, comprising the administration of (a) a compound directly inhibiting the activity of PDE4D7, preferably an antagonist of PDE4D7 enzymatic activity; (b) a compound indirectly inhibiting the activity of PDE4D7; (c) a dominant negative form of the PDE4D7 protein or a biologically active equivalent thereof; (d) a nucleic acid encoding and expressing a dominant negative form of PDE4D7; (e) a miRNA specific for PDE4D7; (f) a PDE4D7 antisense molecule; (g) a siRNA specific for PDE4D7; (h) an aptamer specific for the PDE4D7 expression product or for the PDE4D7 protein; (i) a small molecule or peptidomimetic capable of specifically binding to the PDE4D7 protein; and/or (j) an antibody specific for the PDE4D7 protein and/or an antibody variant specific for the PDE4D7 protein to an individual, in particular to an individual suffering from malignant, hormone-sensitive prostate cancer or being prognosticated to develop malignant, hormone-sensitive prostate cancer.

In yet another aspect the present invention relates to a stimulatory pharmaceutical composition comprising at least one element selected from the group consisting of: (a) a compound directly stimulating or modulating the activity of PDE4D7, preferably an allosteric agonist of PDE4D7 enzymatic activity; (b) a compound indirectly stimulating or modulating the activity of PDE4D7; (c) the PDE4D7 protein or a biologically active equivalent thereof; (d) a nucleic acid encoding and expressing PDE4D7; (e) a miRNA inhibitor specific for PDE4D7 miRNAs; (f) a demethylation agent; and (g) a phosphodiesterase displacement factor.

The term "a compound directly stimulating or modulating the activity of PDE4D7" as used herein refers to a compound which is capable of increasing the activity of PDE4D7 to degrade cAMP by a direct interaction with PDE4D7. Such a compound may be any direct interactor of PDE4D7, which has positive influence on the catalytic activity of PDE4D7. Such a compound may preferably be an allosteric agonist of the catalytic activity of PDE4D7, e.g. a homotropic allosteric modulator. Preferred allosteric agonists of PDE4D7 are cAMP or cAMP analogs. Other directly stimulating compounds envisaged by the present invention are ions, preferably biologically active mono- and bivalent cations like $Ca^{2+}$, $Mg^{2+}$.

The term "a compound indirectly stimulating or modulating the activity of PDE4D7" as used herein refers to a compound which is capable of increasing the activity of PDE4D7 to degrade cAMP by an interaction with a direct interactor of PDE4D7 ("indirect interactor") or via an indirect working pathway not involving an interaction with PDE4D7. Such a compound may be any direct interactor of an interactor of PDE4D7. The effect conveyed by the direct interactor of an interactor of PDE4D7 may be either positive if the interactor of PDE4D7 itself has a positive effect on the activity of PDE4D7, or negative, if the interactor of PDE4D7 has a negative effect on the activity of PDE4D7. Typically positively working indirect interactors may stimulate the agonistic effect of direct interactors, e.g. provoke the increase of concentration of allosterically working compounds like cAMP or analogs thereof by inhibiting cAMP degrading processes not conferred by PDE4D7, by raising the cAMP production etc.

Alternatively, such positively working indirect integrators may provoke a modification of the binding behavior of directly binding proteins, leading to an increased PDE4D7 activity. Typically negatively working indirect interactors may have an inhibitory effect on inhibitors of PDE4D7. Examples of such interactors are enzymatic activities degrading PDE4D7 inhibitors, or proteins capable of binding and quenching PDE4D7 inhibitors. Alternatively, such interactors may inhibit activities leading to a degradation of PDE4D7, e.g. proteinase inhibitors. Further examples and their implementation would be known to the person skilled in the art.

Alternatively, an indirect stimulation of the PDE4D7 activity may be conveyed by compounds activating, protecting or sustaining the expression of the endogenous PDE4D7 gene. Examples of such compounds are PDE4D7 specific transcription factors, PDE4D7 specific mRNA stabilizing activities or PDE4D7 splice factors. Further examples and their implementation would be known to the person skilled in the art.

The "PDE4D7 protein" comprised in the stimulatory pharmaceutical composition may be a PDE4D7 protein as defined herein above. In particular, it may be a protein being encoded by splice variant 7 of the human phosphodiesterase PDE4D, more preferably it may have the amino acid sequence as defined in Genbank Accession No: AF536976 (version AF536976.1, GI:22901883 as of 3 Mar. 2009), and even more preferably it may have the amino acid sequence as set forth in SEQ ID NO: 2. The "PDE4D7 protein" as used in this context also comprises amino acid sequences being at least 60%, 70%, 75%, 80%, 85%, 90%, 91%, 92%, 93%, 94%, 95%, 96%, 97%, 98% or 99% identical to the sequence as set forth in SEQ ID NO: 2 and amino acid sequences being encoded by nucleotide sequences being at least 60%, 70%, 75%, 80%, 85%, 90%, 91%, 92%, 93%, 94%, 95%, 96%, 97%, 98% or 99% identical to the sequence as set forth in SEQ ID NO: 1. Homologous variants of PDE4D7, in particular those mentioned above, preferably have PDE4D7 functionality, i.e. are capable of degrading cAMP. In a further embodiment of the invention the homologous variants of PDE4D may additionally or alternatively have a similar or identical localization pattern as PDE4D7 within a cell or within a tissue type.

In a further preferred embodiment the region or homology between the homologous variants of PDE4D7 and PDE4D7 may be confined to the C-terminal part of the protein. For instance, the homologous variant may comprise an N-terminal domain being present in PDE4D7 and a remainder of the protein having a degree of homology to PDE4D7 as indicated herein above. The N-terminal portion of the homologous variant may comprise amino acids 1 to 120, 1 to 110, 1 to 100, 1 to 90, 1 to 80, 1 to 70, 1 to 60, 1 to 50, 1 to 40, 1 to 30, 1 to 20 or 1 to 10 derived from PDE4D7.

The term "biologically active equivalent of PDE4D7" as used herein refers to a PDE4D7 protein which is capable of performing all or a majority of PDE4D7 functions. Preferably, it relates to proteins being capable of degrading cAMP. In a further embodiment of the invention the biologically active equivalents of PDE4D7 may additionally or alternatively have a similar or identical localization pattern as PDE4D7 within a cell or within a tissue type. Biologically active equivalents of PDE4D7 may also comprise PDE4D7 variants as defined herein above.

PDE4D7 or biologically active equivalents of PDE4D7 according to the present invention may be produced recombinantly by any suitable method known to the person skilled in the art. The present invention, thus, also encompasses methods for the production of PDE4D7 or biologically active equivalents of PDE4D7.

Accordingly, the present invention contemplates vectors containing the polynucleotides encoding PDE4D7 or biologically active equivalents of PDE4D7 as defined herein above, host cells, and the production of PDE4D7 or biologically active equivalents of PDE4D7 by recombinant techniques.

A suitable vector may be, for example, a phage, plasmid, viral, or retroviral vector. Retroviral vectors may be replication competent or replication defective. In the latter case, viral propagation generally will occur only in complementing host cells. Polynucleotides encoding PDE4D7 or biologically active equivalents of PDE4D7 may be joined to a vector or carrier containing a selectable marker for propagation in a host. A corresponding polynucleotide insert may be operatively linked to an appropriate promoter, such as the phage lambda PL promoter, the E. coli lac, trp, phoA and tac promoters, the SV40 early and late promoters and promoters of retroviral LTRs, or the PSA promoter. Other suitable promoters are known to the person skilled in the art. The expression constructs may further contain sites for transcription initiation, termination, and, in the transcribed region, a ribosome binding site for translation. The coding portion of the transcripts expressed by the constructs will preferably include a translation initiating codon at the beginning and a termination codon (UAA, UGA or UAG) appropriately positioned at the end of the polypeptide to be translated.

The polypeptides or proteins may be glycosylated or may be non-glycosylated or may otherwise by modified. In addition, polypeptides or proteins may also include an initial modified methionine residue, in some cases as a result of host-mediated processes. Furthermore, the polypeptide, protein or peptide may be modified by acetylation, pegylation, hesylation, formylation, phosphorylation, amidation, derivatization by known protecting/blocking groups, specific chemical cleavage, proteolytic cleavage, a linkage to a cellular ligand or other protein or hapylation, i.e. a fusion with a glycine-rich homo-amino-acid polymer (HAP), etc. Such modifications may be carried out by suitable techniques known to the person skilled in the art. Additionally, the polypeptide, peptide or variant may contain one or more non-classical amino acids.

In addition, PDE4D7 or biologically active equivalents of PDE4D7 of the invention can be chemically synthesized using techniques known in the art, e.g. by using a peptide synthesizer.

The "nucleic acid encoding and expressing PDE4D7" comprised in the stimulatory pharmaceutical composition as defined herein above refers to any suitable carrier element, e.g. as described herein above, comprising an expressable PDE4D7 gene. Preferably, such a carrier element may comprise the sequence as defined in Genbank Accession No: AF536976 (version AF536976.1, GI:22901883 as of 3 Mar. 2009), more preferably the nucleotide sequence as set forth in SEQ ID NO: 1. Such a carrier element may also comprises nucleotide sequences showing a high degree of homology to PDE4D7, e.g. nucleic acid sequences being at least 60%, 70%, 75%, 80%, 85%, 90%, 91%, 92%, 93%, 94%, 95%, 96%, 97%, 98% or 99% identical to the sequence as set forth in SEQ ID NO: 1 or nucleic acid sequences encoding amino acid sequences being at least 60%, 70%, 75%, 80%, 85%, 90%, 91%, 92%, 93%, 94%, 95%, 96%, 97%, 98% or 99% identical to the sequence as set forth in SEQ ID NO: 2. Alternatively, the carrier may comprise the genomic sequence of PDE4D, preferably the sequence as defined in ENSEMBL database entry ENSG00000113448 (Version ENSG00000113448.8, Ensembl release 53—March 2009), which corresponds to SEQ ID NO: 6, or derivable from Genbank Accession No. AC008934 (Version AC008934.5, GI:17386235 as of 24 Mar. 2009) in combination with Genbank Accession No. ACO34234 (Version ACO34234.4, GI:18390182 as of 24 Mar. 2009) or as derivable from Wang et al., 2003, Cell Signal., 15(9): 883-91. More preferably, the carrier may comprise the genomic sequence of PDE4D as defined in SEQ ID NO: 6.

Furthermore, biologically active equivalents of PDE4D7 as defined herein above may be comprised in a carrier of the present invention.

The polynucleotide encoding PDE4D7 may preferably be joined to a vector containing a selectable marker for propagation in a human cell. In a preferred embodiment the polynucleotide insert may be operatively linked to a PSA promoter.

In one embodiment of the present invention nucleic acids encoding and expressing PDE4D7 as defined herein above may be provided via living therapeutics. The term "living therapeutic" means that PDE4D7 or biologically active equivalents of PDE4D7 as defined herein above are expressed in any suitable live carrier. Accordingly, the present invention relates to corresponding polynucleotides which are suitable for expression in a living cell. The present invention also relates to vectors containing such polynucleotides, appropriate host cells, and the production of polypeptides by recombinant techniques in said host cells.

The term "live carrier" relates to any appropriate living host cell or virus known to the person skilled in the art. Representative examples of appropriate hosts include, but are not limited to, bacterial cells such as *Escherichia coli* or *Lactobacillus*, fungal cells, such as yeast cells, protozoa, insect cells, or animal cells. Preferably, the term relates to attenuated bacteria, attenuated fungal cells or attenuated protozoa. Representative examples of appropriate viruses include viruses of the group of adenoviruses, retroviruses or lentiviruses, preferably attenuated viruses of the group of adenoviruses, retroviruses or lentiviruses. In a preferred embodiment, probiotic bacterial cells, in particular probiotic *Escherichia coli* or *Lactobacillus* cells may be used. More preferably, cells of *Escherichia coli* Nissle 1973 and even more preferably cells of *Lactobacillus casei* or *Lactobacillus zeae* 393 may be used.

The "miRNA inhibitor specific for PDE4D7 miRNA" comprised in the stimulatory pharmaceutical composition as defined herein above refers to a nucleic acid molecule encoding a nucleic acid sequence complementary to a PDE4D7 miRNA or microRNA molecule. The term "complementary" as used herein refers to a perfect complementary between the miRNA inhibitor nucleic acid (sense molecule) and the miRNA (antisense molecule) without any mismatch, as well as situations in which the nucleic acid contains any base mismatches and/or additional or missing nucleotides in comparison to the miRNA molecule. In other embodiments, the two molecules comprise one or more base mismatches or differ in their total numbers of nucleotides (due to additions or deletions). In further embodiments, the "complementary" miRNA inhibitor nucleic acid molecule comprises at least ten contiguous nucleotides showing perfect complementarity with a sequence comprised in the miRNA molecule.

Typically miRNA inhibitor nucleic acid molecules are naturally occurring DNA- or RNA molecules or synthetic nucleic acid molecules comprising in their sequence one or more modified nucleotides which may be of the same type or of one or more different types.

It is, for example, envisaged by the present invention that such a miRNA inhibitor nucleic acid molecule comprises at least one ribonucleotide backbone unit and at least one deoxyribonucleotide backbone unit. Furthermore, the miRNA inhibitor nucleic acid molecule may contain one or more modifications of the RNA backbone into 2'-O-methyl group or 2'-O-methoxyethyl group (also referred to as "2'-O-methylation"), which prevented nuclease degradation in the culture media and, importantly, also prevented endonucleolytic cleavage by the RNA-induced silencing complex nuclease, leading to irreversible inhibition of the miRNA. Another possible modification, which is functionally equivalent to 2'-O-methylation, involves locked nucleic acids (LNAs) representing nucleic acid analogs containing one or more LNA nucleotide monomers, as defined herein above.

Another class of silencers of miRNA expression to be used in the context of the present invention comprises chemically engineered oligonucleotides named "antagomirs", which represent single-stranded RNA molecules conjugated to cholesterol. The molecules may comprise between 19 and 25 nucleotides. Preferably, the molecule comprises 20, 21, 22, 23 or 24 nucleotides. More preferably, the molecule comprises 23 nucleotides (further details may be derived from Krutzfeldt et al., 2005, Nature, 438: 685-689).

In another embodiment of the present invention miRNA inhibitors as defined herein above may be provided in the form of expression vectors to be introduced into tissue or cells. Alternatively, such vectors may also be introduced in living therapeutics as defined herein above.

Typically, RNAs may be produced from transgenes provided in the form of tranfection or transient expression vectors or carriers. For instance, competitive miRNA inhibitors may be provided as transcripts expressed from strong promoters, containing more than one, preferably multiple, tandem binding sites to a microRNA of interest. A "microRNA sponge" as described in Ebert et al., 2007, Nat. Methods, 4: 721-726 is an illustrative, non-limiting example of this technique.

The "demethylation agent" comprised in the stimulatory pharmaceutical composition as defined herein above refers to an agent capable of demethylating chromatine structures, preferably promoter regions, more preferably the PDE4D7 promoter. Examples of demethylation agents to be used in the context of the present invention are 5-aza-2'-deoxycytidine and 5-azacytidine, which reactivate genes inappropriately silenced by structural chromatin changes that involve DNA methylation and which can reverse these changes and, therefore, restore principal cellular pathways. This typically results in gene re-expression and reversion of some aspects of the transformed state. 5-azacytidine and 5-aza-2'-deoxycytidine typically inactivate DNA cytosine C5-methyltransferases through the formation of stable complexes between the 5-aza-2'-deoxycytidine residues in DNA and the enzyme, thereby mimicking a stable transition state intermediate when bound to the methyltransferase enzyme.

A further agent, which may be comprised in a stimulatory pharmaceutical composition according to the present invention, either per se or in combination with 5-aza-2'-deoxycytidine and/or 5-azacytidine, is trichostatin A (TSA).

The "phosphodiesterase displacement factor" comprised in the stimulatory pharmaceutical composition as defined herein above refers to a compound which is capable of disturbing or disrupting the interaction of phosphodiesterases, in particular PDE4D7, with interacting partner or interactors. Such a process may ultimately lead to an association of PDEs, in particular PDE4D7, with different interaction partners than before and, in consequence, to a redistribution of PDEs. Such new interaction partners may sequester PDE, in particular PDE4D7, and correspondingly modify cellular behaviors, e.g. provoke influences on receptor binding or other downstream activities. Examples of protein partners which may be involved in such a displacement reaction and/or are capable of sequestering PDE, in particular PDE4D7 are anchoring proteins like AKAPs, scaffold proteins like DISC1, beta-arrestin or RACK1, regulatory proteins like XAP2/AIP/ARA9, cAMP binding proteins like PKA-R subunits or EPACs or receptors like the beta1-adrenoceptor, as well as enzymes like ERK.

Preferred phosphodiesterase displacement factors are peptides, peptidomimetics, small molecules, antibodies and aptamters.

A "peptide" in the context of a phosphodiesterase displacement factor refers to a stretch of amino acids present in or representing the phosphodiesterase molecule, in particular PDE4D7, or an interacting or sequestering protein as defined herein above. The stretch of amino acids comprised in the peptide may have a length of 5 to 100 amino acids, preferably of 10 to 50 amino acids, more preferably of 20 to 30 amino acids. The stretches may be entirely identical to the PDE or interactor protein or a portion thereof or may comprise sequence variations. For example, the peptide sequence may comprise modified amino acid residues at up to 25% of all positions, preferably modifications which do not change the structural properties or the binding properties of the molecule. The amino acid sequence present in the peptide may alternatively represent spatial domains of the PDE or interactor protein and correspondingly comprise a juxtaposition of amino acid stretches which are not adjoined in the primary sequence of the molecules.

A "peptidomimetic" in the context of a phosphodiesterase displacement factor refers is a small protein-like chain designed to mimic a peptide. Such a peptidomimetic may arise from a modification of an existing peptide, e.g. a peptide as defined herein above, in order to alter the molecule's properties. A peptidomimetic may arise from a modification which changes the molecule's stability or binding capability. These modifications typically involve changes to the peptide that will not occur naturally. For example, a peptidomimetic according to the present invention may have altered peptide backbones or may comprise non-natural amino acids. Preferably, a peptidomimetic according to the present invention may represent a phosphodiesterase molecule, in particular PDE4D7, or an interacting or sequestering protein as defined herein above.

In one embodiment of the present invention a peptidomimetic may block the interaction between PDE, in particular PDE4D7, and its interactor. In another embodiment of the present invention a peptidomimetic may enhance the interaction between PDE, in particular PDE4D7, and its interactor.

Methods and techniques for the preparation of peptidomimetics as well as assays for the testing of peptidomimetics are known to the person skilled in the art.

A "small molecules" in the context of a phosphodiesterase displacement factor refers to a small organic compound that is preferably biologically active, i.e. a biomolecule, but is preferably not a polymer. Such an organic compound may have any suitable form or chemical property. The compound may be a natural compound, e.g. a secondary metabolites or an artificial compound, which has been designed and generated de novo. In one embodiment of the present invention a small molecule is capable of blocking the interaction between PDE, in particular PDE4D7, and its interactor. In another embodiment of the present invention a small molecule may enhance the interaction between PDE, in particular PDE4D7, and its interactor. Methods and techniques for the identification and preparation of small molecules as well as assays for the testing of small molecules are known to the person skilled in the art.

An "antibody" or an "aptamer" in the context of a phosphodiesterase displacement factor refers to a PDE4D7 specific antibody or antibody variant or fragment as defined herein above, or to a PDE4D7 specific aptamer as defined herein above, having the capability of disturbing or disrupting the interaction between PDE, in particular PDE4D7, and one or more of its interactors. Alternatively, the terms may also refer to antibodies or aptamers binding to any one or more of the PDE4D7 interactors as described herein above, having likewise the capability of disturbing or disrupting the interaction between PDE, in particular PDE4D7, and one or more of its interactors. Methods for the production or testing of antibodies or aptamers have been described herein above and/or are known to the person skilled in the art.

In a further preferred embodiment said inhibitory pharmaceutical composition as defined above or said stimulatory pharmaceutical composition as defined above may be used for the treatment of prostate cancer in dependence of the expression level of PDE4D7, wherein said level of expression is determined and/or monitored according to the steps of
   (a) determining the level of PDE4D7 in a sample;
   (b) determining the level of expression of a reference gene in a sample; and
   (c) normalizing the measured expression level of PDE4D7 to the expression of the reference gene. The level of PDE4D7 may be determined on the nucleic acid, protein or activity level as described herein above. Preferred is the determination of the amount of PDE4D7 transcript(s) and/or protein. In addition the level of a reference gene as defined herein above in a sample may be determined. A preferred reference gene in the context of this embodiment is PDE4D5, as described herein above.

The term "in dependence of the expression level of PDE4D7" means that the choice for the administration of an inhibitory pharmaceutical composition or a stimulatory pharmaceutical composition may be made after the level of PDE4D7 in a sample has been determined, preferably in comparison to a reference gene like PDE4D5.

In a particularly preferred embodiment of the present invention for increased and/or increasing levels of PDE4D7 an inhibitory pharmaceutical composition according to the present invention is to be administered, and for decreased and/or decreasing levels of PDE4D7 a stimulatory pharmaceutical composition according to the present invention is to be administered.

The term "increased" as used in this context means that the level of PDE4D7 gene expression in a test sample is elevated by, for example, 5%, 6%, 7%, 8%, 9%, 10%, 15%, 20%, 25%, 30%, 40%, 50%, or more than 50% in comparison to the PDE4D7 expression in a control sample, or at least 0.1 fold, at least 0.2 fold, at least 1 fold, at least 2 fold, at least 5 fold, or at least 10 fold or more in comparison to the PDE4D7 expression in a control sample; or when the PDE4D7 gene expression is elevated by, for example, 5%, 6%, 7%, 8%, 9%, 10%, 15%, 20%, 25%, 30%, 40%, 50%, or more than 50% in comparison to the expression of a reference gene in a control sample, or at least 0.1 fold, at least 0.2 fold, at least 1 fold, at least 2 fold, at least 5 fold, or at least 10 fold or more elevated in comparison to the expression of a reference gene. In a specific embodiment, the expression of a reference gene may also be normalized or adjusted to the expression of additional genes or markers, e.g. housekeeping genes. As a preferred control sample or reference point a non-cancerous control, healthy tissue, tissue or cells derived from a healthy individual or benign tumor tissues or data derived therefrom etc. may be used. Alternatively any other control sample or control point may also be used.

The term "increasing" refers to correspondingly determined expression values which tend to augment over a certain period of time, i.e. which become higher after repeated determination steps, e.g. every 4 weeks, 6 weeks, two months, 4 months, 6 months, 8 months, 12 months, 1.5 years, 2 years, 2.5 years etc. An "increasing" PDE4D7 expression level may accordingly be elevated by 0.5 to more than 100% in every testing session, preferably be elevanted by 10%, 20%, 30%, 40%, 50% etc. The increase itself depends on the frequency of testing and the significance may accordingly be adjusted, as the person skilled in the art would be aware of.

In a preferred embodiment an increased or increasing PDE4D7 level may be determined in the early stages of prostate cancer development, i.e. up to tumor stage of hormone-sensitive prostate cancer has. Alternatively, histological determinations may provide independent information on the staging of a prostate tumor. In dependence of such an independent determination a benign prostate tumor stage or a hormone-dependent tumor stage may be diagnosed. In this situation an increased or increasing PDE4D7 level (in comparison to a non-cancerous or healthy control or stage) may trigger the administration of an inhibitory pharmaceutical composition according to the present invention.

Alternatively, the level of PSA may be additionally be determined. In case a low PSA level of below 2.0-3.0 ng/ml is encountered an increased or increasing level of PDE4D7 may trigger the administration of an inhibitory pharmaceutical composition according to the present invention.

The term "decreased" as used in this context means that the level of PDE4D7 gene expression in a test sample is reduced by, for example, 5%, 6%, 7%, 8%, 9%, 10%, 15%, 20%, 25%, 30%, 40%, 50%, or more than 50% in comparison to the PDE4D7 expression in a control sample, or at least 0.1 fold, at least 0.2 fold, at least 1 fold, at least 2 fold, at least 5 fold, or at least 10 fold or more in comparison to the PDE4D7 expression in a control sample; or when the PDE4D7 gene expression is decreased by, for example, 5%, 6%, 7%, 8%, 9%, 10%, 15%, 20%, 25%, 30%, 40%, 50%, or more than 50% in comparison to the expression of a reference gene in a control sample, or at least 0.1 fold, at least 0.2 fold, at least 1 fold, at least 2 fold, at least 5 fold, or at least 10 fold or more decreased in comparison to the expression of a reference gene. In a specific embodiment, the expression of a reference gene may also be normalized or adjusted to the expression of additional genes or markers, e.g. housekeeping genes. As a preferred control sample or reference point a cancerous control, in particular a hormone-sensitive or hormone-dependent prostate cancer tissue or data derived therefrom etc. may be used. Alternatively any other control sample or control point may also be used.

The term "decreasing" refers to correspondingly determined expression values which tend to become lower over a certain period of time, i.e. which become lower after repeated determination steps, e.g. every 4 weeks, 6 weeks, two months, 4 months, 6 months, 8 months, 12 months, 1.5 years, 2 years, 2.5 years etc. An "increasing" PDE4D7 expression level may accordingly be elevated by 0.5 to more than 100% in every testing session, preferably be elevated by 10%, 20%, 30%, 40%, 50% etc. The decrease itself depends on the frequency of testing and the significance may accordingly be adjusted, as the person skilled in the art would be aware of.

In a preferred embodiment a decreased or decreasing PDE4D7 level may be determined after an increase of PDE4D7 up to tumor stage of hormone-sensitive prostate cancer has already been determined. Alternatively, histological determinations may provide independent information on the staging of a prostate tumor. In dependence of such an independent determination a hormone-sensitive tumor stage may be diagnosed. In this situation a decreased or decreasing PDE4D7 level (in comparison to the starting tumor stage) may trigger the administration of a stimulatory pharmaceutical composition according to the present invention.

Alternatively, the level of PSA in blood may be additionally be determined. In case a PSA level of about 20 ng/ml, e.g. 17, 18, 19, 20, 21, 22, 23, 24, 25 ng/ml etc. and/or higher is encountered and a decreased or decreasing level of PDE4D7 may trigger the administration of a stimulatory pharmaceutical composition according to the present invention.

In a further specific embodiment the present invention envisages a method of monitoring the development of prostate cancer, which encompasses the determination of PDE4D7, preferably in combination with the determination of a reference gene as described herein above, over a certain period of time, i.e. after repeated determination steps, e.g. every 4 weeks, 6 weeks, two months, 4 months, 6 months, 8 months, 12 months, 1.5 years, 2 years, 2.5 years, 3 years, 4 years or any other suitable period of time etc. The method may provide data showing an increase or decrease of the level of PDE4D7 in comparison to controls, e.g. non-cancerous controls, cancerous controls or to earlier data obtained from the same individual. These data may be used to depict or develop a PDE4D7 expression curve over time. With the help of suitable statistical methods known to the person skilled in the art the position within said curve may be determined. In dependence of the position within said curve, i.e. in an augmenting portion or a falling portion of said curve, the presence or future development of hormone-dependent/hormone-sensitive prostate cancer or hormone-resistant prostate cancer may be diagnosed. Correspondingly, either the use of inhibitory pharmaceutical compositions according to the present invention, or stimulatory pharmaceutical compositions according to the present invention is envisaged. Preferably, any such determination may be combined with the determination of secondary biomarkers, e.g. markers for prostate cancer, in particular PSA. In case of low PSA levels (up to 2.0 to 4.0 ng/ml) the PDE4D7 data may be analyses with respect to early prostate cancer, i.e. benign or hormone-dependent/hormone-sensitive prostate cancer. In case of higher PSA levels (higher than about 20 ng/ml, e.g. about 30, 40 or 50 ng/ml) the PDE4D7 data may be analysed with respect to more advanced prostate cancer, i.e. hormone-resistant prostate cancer.

A pharmaceutical composition according to the present invention may be administered to a patient, subject or individual with the help of various delivery systems known to the person skilled in the art, e.g., via encapsulation in liposomes, microparticles, microcapsules, recombinant cells capable of expressing the compound, receptor-mediated endocytosis, construction of a nucleic acid as part of a retroviral or other vector, etc. Methods of introduction may be topical, enteral or parenteral and may include intradermal, intramuscular, intraperitoneal, intravenous, subcutaneous, intranasal, inhalational, epidural, and oral routes. The composition may be administered by any convenient route, for example by infusion or bolus injection, by absorption through epithelial or mucocutaneous linings (e. g., oral mucosa, rectal and intestinal mucosa, etc.) or by inhalation and may be administered together with other biologically active agents. Administration can be systemic or local. A preferred method of local administration is by direct injection.

In another embodiment the pharmaceutical composition may be delivered directly to internal organs, body cavities and the like by use of imaging devices used to guide an injecting needle directly to the site of interest. The pharmaceutical composition may also be administered to disease sites at the time of surgical intervention. In yet another embodiment, the composition can be delivered in a controlled release system.

Preferably the pharmaceutical composition is in a form, which is suitable for oral, local or systemic administration. In a preferred embodiment the pharmaceutical composition is administered locally, orally or systemically.

In a specific embodiment of the present invention the inhibitory pharmaceutical composition may be administered after an immunoassay for stratifying an individual, or a method of identifying an individual for eligibility for prostate cancer as described herein above has been carried out, in particular upon the classification of an individual as having an increased level of PDE4D7. In a further embodiment the pharmaceutical composition comprises a therapeutically effective amount of the ingredients of the pharmaceutical composition of the present invention as defined herein above and a pharmaceutically acceptable carrier. The term "pharmaceutically acceptable" means approved by a regulatory agency or other generally recognized pharmacopeia for use in animals, and more particularly in humans. The term "carrier" refers to a diluent, adjuvant, excipient, or vehicle with which the therapeutic is administered. Such a carrier is pharmaceutically acceptable, i.e. is non-toxic to a recipient at the dosage and concentration employed.

Generally, the ingredients are supplied either separately or mixed together in unit dosage form, for example, as a dry lyophilised powder or water free concentrate in a hermetically sealed container such as an ampoule or sachette indicating the quantity of active agent.

The pharmaceutical composition of the invention can be formulated as neutral or salt forms.

Preferably, the pharmaceutical composition may be administered directly or in combination with any suitable adjuvant known to the person skilled in the art. The composition of the present invention can be administered to an animal, preferably to a mammal. "Mammal" as used herein is intended to have the same meaning as commonly understood by one of ordinary skill in the art. Particularly, "mammal" encompasses human beings.

The term "administered" means administration of a therapeutically effective dose of the aforementioned composition. By "therapeutically effective amount" is meant a dose that produces the effects for which it is administered, preferably this effect is reduction and degradation of PDE4D7. The exact dose will depend on the purpose of the treatment, and will be ascertainable by one skilled in the art using known techniques. As is known in the art and described above, adjustments for systemic versus localized delivery, age, body weight, general health, sex, diet, time of administration, drug interaction and the severity of the condition may be necessary, and will be ascertainable with routine experimentation by those skilled in the art.

The concentration of the active ingredients or compounds of a pharmaceutical composition according to the present invention may be further adjusted to the intended dosage regimen, the intended usage duration, the exact amount and ratio of all ingredients of the composition and further factors and parameter known to the person skilled in the art.

The active agents or compounds according to the present invention may be administered alone or in combination with other treatments. In a preferred embodiment the pharmaceutical composition of the present invention may be administered in combination with an anti-cancer treatment, e.g. a traditional anti prostate cancer treatment.

The pharmaceutical composition of the present invention can also comprise any suitable preservative known to the person skilled in the art.

Furthermore, the preparations according to the invention may also comprise compounds, which have an antioxidative, free-radical scavenger, antierythematous, antiinflammatory or antiallergic action, in order to supplement or enhance their action.

In another preferred embodiment of the present invention active components of the pharmaceutical composition as defined herein above may be fused to a suitable carrier protein, e.g. to Ig Fc receptor proteins or polymeric Ig receptors. Preferably dominant negative forms of PDE4D7 or biologically active equivalents thereof as defined herein above may be provided as fusion proteins. The fusion partner may be provided at the N- or C-terminus.

If the pharmaceutical composition according to the present invention is to be administered in the form of a live cell or living therapeutic as defined herein above, transformed and prepared cells may be administered to a patient in any suitable form known to the person skilled in the art. Preferably living therapeutics may be administered in the form of a composition comprising a microorganism, e.g. a *Lactobacillus* as described above, in an amount between $10^2$ to $10^{12}$ cells, preferably $10^3$ to $10^8$ cells.

In a further preferred embodiment of the present invention the ratio between two or more ingredients in the pharmaceutical composition or medicament may be suitably adjusted according to the skilled person's knowledge.

Suitable assays may optionally be employed to help identify optimal ratios and/or dosage ranges for ingredients of pharmaceutical compositions of the present invention. The precise dose and the ratio between the ingredients of the pharmaceutical composition as defined herein above to be employed in the formulation will, inter alia, depend on the route of administration, and the exact type of disease or disorder, and should be decided according to the judgment of the practitioner and each patient's circumstances. Effective doses or ingredient ratios may be extrapolated from dose-response curves derived from in vitro or (animal) model test systems.

A typical dose can be, for example, in the range of 0.001 to 1000 µg; however, doses below or above this exemplary range are envisioned, especially considering the aforementioned factors.

In another aspect the present invention relates to a medical kit comprising the ingredient of an inhibitory or stimulatory pharmaceutical composition according to the present invention. Preferably, the present invention relates to a medical kit for the treatment or prevention of malignant, hormone-sensitive prostate cancer comprising at least one element selected from the group consisting of (a) a compound directly inhibiting the activity of PDE4D7, preferably an antagonist of PDE4D7 enzymatic activity; (b) a compound indirectly inhibiting the activity of PDE4D7; (c) a dominant negative form of the PDE4D7 protein or a biologically active equivalent thereof; (d) a nucleic acid encoding and expressing a dominant negative form of PDE4D7; (e) a miRNA specific for PDE4D7; (f) a PDE4D7 antisense molecule; (g) a siRNA specific for PDE4D7; (h) an aptamer specific for the PDE4D7 expression product or for the PDE4D7 protein; (i) a small molecule or peptidomimetic capable of specifically binding to the PDE4D7 protein; and (j) an antibody specific for the PDE4D7 protein and/or an antibody variant specific for the PDE4D7 protein.

A medical kit that can be used in the context of the administration of the pharmaceutical composition as defined herein above. In particular, a kit according to the present invention may be used for the treatment or prevention of prostate cancer, e.g. malignant, hormone-sensitive prostate cancer.

The ingredients of a medical kit may, according to the present invention, be comprised in one or more containers or separate entities. They may preferably be formulated as pharmaceutical compositions or medicaments, more preferably they may be formulated as has been described herein above in the context of the pharmaceutical compositions of the present invention, e.g. they may comprise suitable pharmaceutical carriers etc. Particularly preferred are formulations for topical administration as mentioned herein above in the context of pharmaceutical compositions of the invention. The medical kit according to the present invention may optionally also comprise a documentation which indicates the use or employment of the medical kit and its components. Preferably, instructions comprised in the medical kit of the present invention may comprise recommended treatment options, dosage regimens etc. The medical kit may also comprise an instruction leaflet and/or may provide additional information on the use, dosage etc.

The medical kit of the present invention may be administered to a patient according to any suitable dosage regimen known to the person skilled in the art. The medical kit or kit components may preferably be given once a week, more preferably 2 times, 3 times, 4 times, 5 times or 6 times a week and most preferably daily and or 2 times a day or more often, unless otherwise indicated. During progression of the treatment the dosages may be given in much longer time intervals and in need can be given in much shorter time intervals, e.g., several times a day. In a preferred case a response to the treatment may be monitored using herein described methods and further methods known to those skilled in the art and dosages may accordingly be optimized, e.g., in time, amount and/or composition. Progress can be monitored by periodic assessment. It is also envisaged that the medical kit is employed in co-therapy approaches, i.e. in co-administration with other medicaments or drugs, for example antibiotics, antiviral medicaments or IgG or IgA immunoglobulins, cytotoxic anticancer medicaments and, preferably in the case of a medical including an inhibitory pharmaceutical composition, anti-hormone medicaments, more preferably anti-androgens as mentioned herein above.

In a further, specific aspect the present invention relates to a kit comprising ingredients for the determination of the expression of PDE4D7 as defined herein above together with ingredients of a medical kit for the treatment of prostate cancer, in particular malignant hormone-sensitive prostate cancer as defined herein above.

In a further, particularly preferred embodiment of the present invention the cancer to be diagnosed, detected, monitored or prognosticated or whose progression is diagnosed, detected, monitored or prognosticated or which is to be treated with a pharmaceutical composition as mentioned above or by a method of treatment according to the present invention is a hormone-sensitive stage I to IV prostate cancer, a hormone-sensitive recurrent prostate cancer, or a hormone-sensitive metastatic prostate cancer.

A "hormone-sensitive stage I to IV prostate cancer" as used herein denotes a prostate cancer which can be classified according to the TNM classification by the International Union Against Cancer (UICC) into stages I to IV. Preferably, the term relates to the classification of prostate cancer pursuing the following T—Primary Prostate Tumor classification schedule:

TX. Primary tumor cannot be assessed.
T0. No evidence of primary tumor.
T1. Clinically inapparent tumor not palpable or visible by imaging.
T1a. Tumor incidental histological finding in 5% or less of tissue resected.
T1b. Tumor incidental histological finding in more than 5% of tissue resected.
T1c. Tumor identified by needle biopsy (e.g., because of elevated PSA).
T2. Tumor confined within prostate (Tumor found in one or both lobes by needle biopsy, but not palpable or visible by imaging, is classified as T1c).
T2a. Tumor involves one half of one lobe or less.
T2b. Tumor involves more than half of one lobe, but not both lobes.
T2c. Tumor involves both lobes.
T3. Tumor extends through the prostatic capsule (Invasion into the prostatic apex, or into (but not beyond) the prostate capsule, is not classified as T3, but as T2).
T3a. Extracapsular extension (unilateral or bilateral).
T3b. Tumor invades seminal vesicle(s).
T4. Tumor is fixed or invades adjacent structures other than seminal vesicles: bladder neck, external sphincter, rectum, levator muscles, or pelvic wall.
N1. Tumor invades regional lymph node(s).
M1a. Tumor invades non-regional lymph node(s).
M1b. Tumor invades bone(s).
M1c. Tumor invades other site(s).
G Histopathological Grading.
GX. Grade cannot be assessed.
G1. Well differentiated (slight anaplasia) (Gleason 2-4).
G2. Moderately differentiated (moderate anaplasia) (Gleason 5-6).
G3-4. Poorly differentiated/undifferentiated (marked anaplasia) (Gleason 7-10), wherein T categories are physical examination, imaging, endoscopy, biopsy, and biochemical tests, N categories are physical examination and imaging tests and M categories are physical examination, imaging, skeletal studies, and biochemical tests, and wherein stages I to IV of malignant prostate cancer correspond to the following scheme:

Stage I: T1a; N0; M0; G1
Stage II: T1a; N0; M0; G2, 3-4, or
 T1b. c; N0; M0; any G, or
 T1. T2; N0; M0; any G
Stage III T3; N0; M0; any G
Stage IV T4; N0; M0; any G, or
 Any T; N1; M0; any G, or
 Any T; Any N; M1; any G, wherein stage IV does not include hormone-resistant prostate cancer.

A "hormone-sensitive recurrent prostate cancer" as used herein denotes a prostate cancer whose growth and progression is regulated and dependent on a male sex hormone. A preferred example of such a male sex hormone is an androgen.

A "hormone-sensitive metastatic prostate cancer" as used herein denotes prostate cancer whose growth and progression is not regulated and independent on a male sex hormone. A preferred example of such a male sex hormone is androgen.

The following examples and figures are provided for illustrative purposes. It is thus understood that the example and figures are not to be construed as limiting. The skilled person in the art will clearly be able to envisage further modifications of the principles laid out herein.

EXAMPLES

Example 1

Quantitative RT-PCR Assay

From the individual and samples depicted in FIGS. 1A and B RNA was isolated and transcribed by standard procedures into cDNA.

qRT-PCR: Materials and Methods

RNA samples were treated with DNase to ensure there was no DNA contamination. Prior to cDNA synthesis RNA samples were treated with DnaseI (In Vitrogen) for 30 min at 37° C. 1 µg of the RNA sample was then treated with Superscript Vilo (In Vitrogen) to synthesize the first strand DNA for qPCR analysis as per manufacturer's guidelines. DNA samples were then treated with RnaseH1 30 min at 37° C.

Resulting DNA was diluted to a final concentration of 50-60 ng/µl, of which 5 µl was added to each reaction well of a 96-well optical reaction plate.

Quantitative PCR reactions were performed using an ABI Prism 7300 machine in a reaction volume of 15 µl according to the following protocol:
7.5 µl Platinum qPCR SuperMix-UDG with ROX (InVitrogen)
2.2 µl nuclease free water
0.1 µl 100 pmol/µl Probe
0.1 µl 100 pmol/µl Forward Primer
0.1 µl 100 pmol/µl Reverse Primer
Total volume in each reaction well was 15 µl including cDNA.

The PCR itself was run over 40 cycles under the following program:

| Stage | Repetitions | Temperature (° C.) | Time |
|---|---|---|---|
| 1 | 1 | 50 | 2 seconds |
| 2 | 1 | 95 | 2 minutes |
| 3 | 40 | 95 | 15 seconds |
|   |   | 60 | 1 minute | qRT-PCR Primers and Probes (TAQMAN)

The following oligonucleotide primers and probes were used for RT-PCR on PDE4D7:

```
Forward Primer
                                   (SEQ ID NO: 3)
5'-TGCCTCTGAGGAAACACTAC-3', Reverse Primer
                                   (SEQ ID NO: 4)
5'-GCTGAATATTGCGACATGAAAG-3'
giving rise to a product of the length 101.

As probe the sequence
                                   (SEQ ID NO: 5)
5'-CCAGTAATGAAGAGGAAGACCCTTTCCGC-3'
was used.
```

The probe-sets was designed to target the unique N-terminal regions of the PDE isoform. The amplicon was designed to be within the optimal range for Taqman assays on ABI Prism technology. All assays were performed in quadruplicate to maximize data integrity. A GAPDH reference probe was also included to which all consecutive data were referenced against.

qRT-PCR: Data Analysis

A-ddCt approach was carried out in order to normalize and compare different RT-PCR experiments. Ct values were obtained by manual threshold observation where each probeset was amplifying exponentially at a comparable efficiency. In particular, the following steps were carried out:

1.) The difference in cycle number (Ct) between reference and gene of interest (GAPDH subtracted from Gene of interest) was calculated to give the experimental sample (ES) dCt.

2.) One sample was selected as standard to be compared against (LNCaP) (C) and its dCt was calculated.

3.) The change in cycle number difference could be derived by dCt(ES)–dCt(C)=ddCt 4.) The final comparable expression values could be derived by 2–ddCt in order to take into account the doubling of DNA after each cycle, hence showing the amount of mRNA in comparison to LNCaP.

This operation gave a value in comparison to LNCaP (which will have the value of 1), i.e. any value >1 was considered to be an increase in expression, a value of <1 was considered to be a decrease in expression.

It was accordingly assumed that the extension efficiencies of all the PCR reactions are within a certain range, resulting in a value of 1.

Percentage Approach to Normalize and Compare Different RT-PCR Experiments

For each probe-set a Ct (cycle number) value was obtained. This was generated by finding a baseline which intersected the amplification curves during their exponential phase. The baselines were generated dynamically according to the curves obtained in each experiment. The Ct (intersect or cycle) values of the GOIs were then subtracted from the Ct value of the GAPDH standard.

According to the formula Ct(GAPDH)–Ct(GOI)=dCt, given that GOI Ct values are always larger than the reference gene the dCt value resulted in negative numbers, i.e. a –dCt value. Based on the doubling effect of each cycle and the absolute values were determined according to the Comparative Expression Value=2–dCt.

Due to the very small values gained from this calculation the value multiplied by 1000 for handling purposes.

A Box Plot of relative expression levels of PDE4D7 against GAPDH of normal, benign and malignant prostate tissue samples may be derived from FIG. 2. In particular, in this figure a comparison between normal/control tissue samples (7), benign tissue samples (31) and malignant tissue samples (10) is shown. The results were obtained based on a T-test (2-tailed) with a p-value benign vs. malignant (difference of medians) of 0.00025. The Fig. shows that there is a significant increase in relative expression between normal and benign tissue on the one hand and malignant prostate tissue on the other hand.

Figure 3:
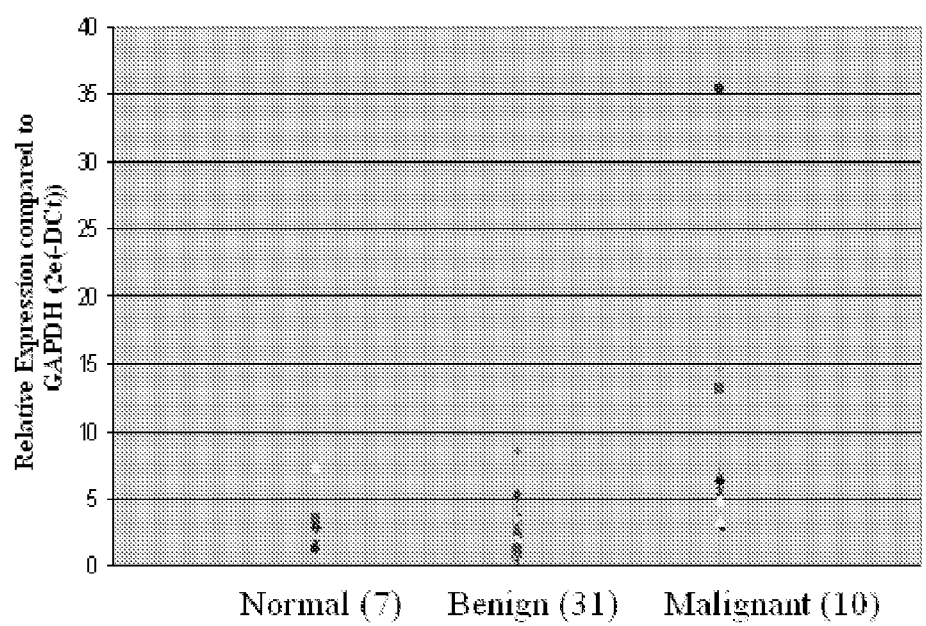
FIG. 3 depicts a Scatter Blot of relative expression levels of PDE4D7 against GAPDH of normal, benign and malignant prostate tissue samples. Indicated are individual relative expression values of PDE4D7 in normal, benign and malignant prostate tissues. The expression values are relative to the expression of GAPDH.

A Scatter Blot of relative expression levels of PDE4D7 against GAPDH of normal, benign and malignant prostate tissue samples is provided in FIG. 3. In this figure the individual relative expression values of PDE4D7 in normal, benign and malignant prostate tissues is indicated. Expression values are given as relative to the expression of GAPDH. The results show that the application of an arbitrary cutoff of 4.7 provides a diagnostic test specificity for discrimination between benign and malignant prostate samples of 92% at a sensitivity of 70%.

Figure 4:
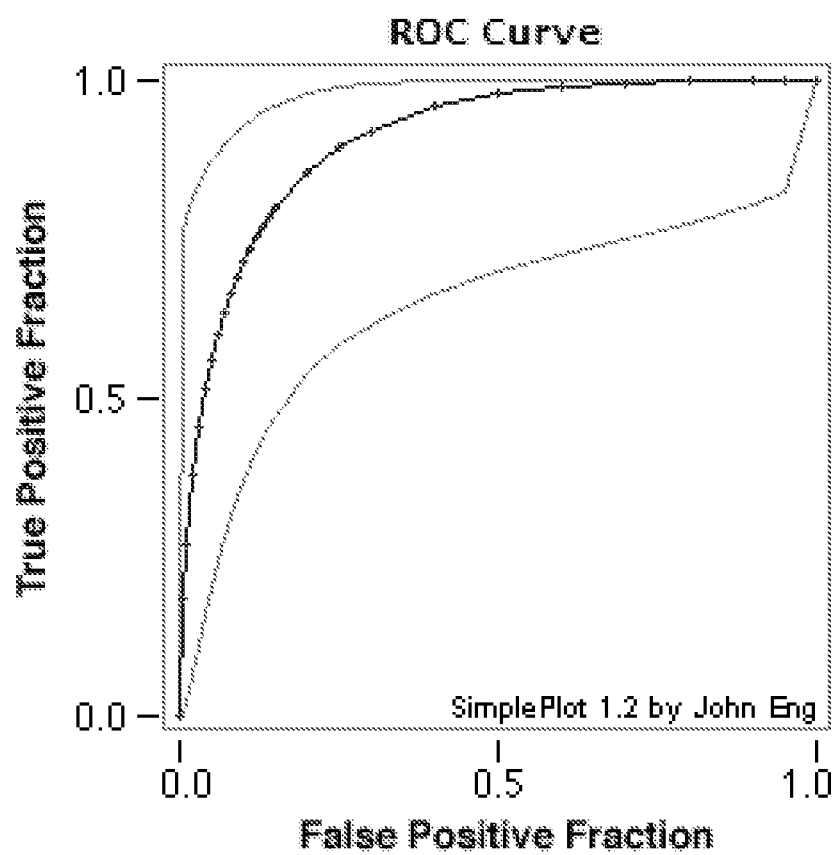
FIG. 4 depicts a ROC curve analysis of PDE4D7 expression in benign vs. malignant prostate samples.

A corresponding ROC curve analysis of PDE4D7 expression in benign vs. malignant prostate samples is provided in FIG. 4. Here, the relative PDE4D7 expression values of benign vs. malignant prostate tissue samples were analyzed by plotting the FP vs. the TP classifications based on relative PDE4D7 expression (compared to GAPDH) in benign vs. malignant prostate tissues (see box plot above). The AUC (area under curve) was calculated with 0.91

Figure 5:
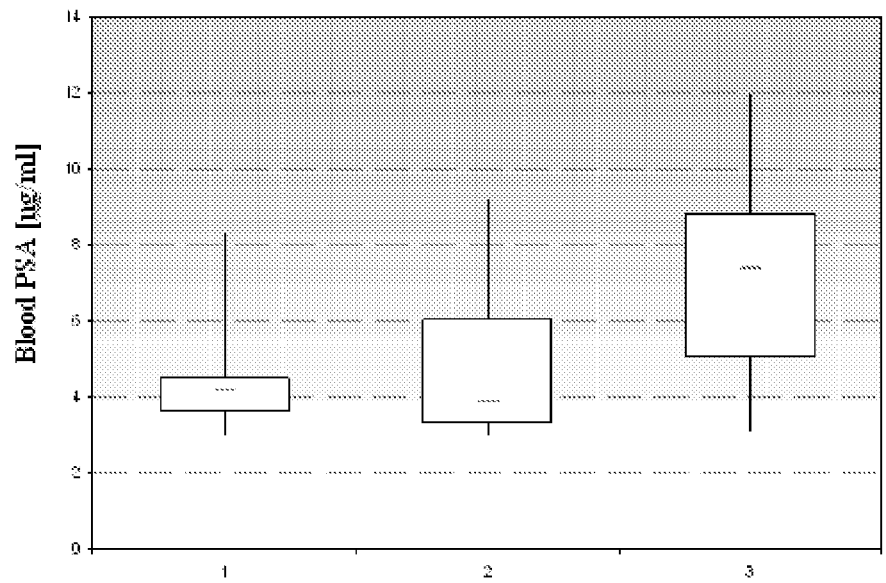
FIG. 5 shows a Box Plot of human blood PSA values of 90 men with benign and different stages of malignant prostate disease. In column 1 men with a benign prostate disease are indicated, in column 2 men with malignant prostate disease, presenting with small cancers and in column 3 men with malignant prostate disease, presenting with significant cancers are indicated.

For illustrative and comparison purposes a Box Plot of human blood PSA values of 90 men with benign and different stages of malignant prostate disease is indicated in FIG. 5. In this figure, a comparison between men with a benign prostate disease (30), men with malignant prostate disease (30), presenting with small cancers and men with malignant prostate disease (30), presenting with significant cancers was carried out. This figure shows that the expression increase between benign prostate tumors and malignant tumors is less pronounced in comparison to the PDE4D7 results.

Figure 6:
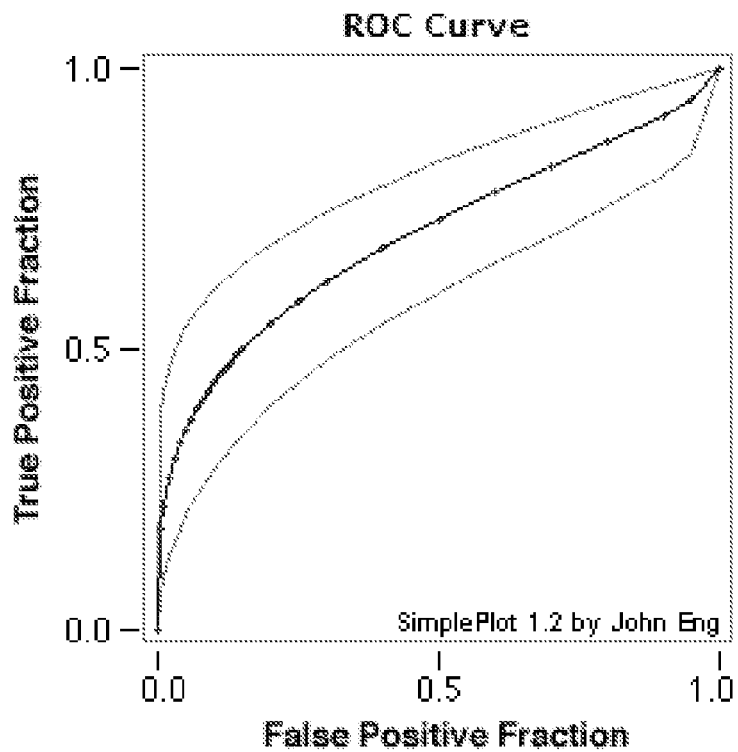
FIG. 6 depicts a ROC curve analysis of blood PSA levels in men with benign vs. different stages of malignant prostate disease.

A corresponding ROC curve analysis of blood PSA levels in men with benign vs. different stages of malignant prostate disease is provided in FIG. 6. Here, the expression values of blood PSA of men with benign (30) vs. malignant (30 small, 30 significant cancers, see box plot above) prostate samples were analyzed by plotting the FP vs. the TP classifications based on PSA values in blood in benign vs. malignant disease. The AUC (area under curve) was calculated with 0.7.

Example 2

Detection of PDE4D7 and PDE4D5 in Quantitative RT-PCR Assays with Human Tissue Samples (Origene's Human Prostate Cancer Tissue Panels I and II)

The relative gene expression of human PDE4D7 and human PDE4D5 as reference gene was evaluated various patient panels.

Materials and Methods

Details on the samples used in the qPCR measurements of PDE gene expression experiment are given in Tables 1 and 2, below:

TABLE 1

Origene's Human Prostate Cancer Tissue panel I (HPRT501, Origene Inc):

| gender | age | tissue | appearance | diagnosis | tumorgrade | normal | lesion | tumor |
|---|---|---|---|---|---|---|---|---|
| Male | 67 | Prostate/Prostate | Normal | Adenocarcinoma of prostate | Gleason Score: 3 + 4 = 7/10 | 100 | 0 | 0 |
| Male | 68 | Prostate/Prostate | Normal | Adenocarcinoma of prostate | Gleason Score: 4 + 3 = 7/10 | 100 | 0 | 0 |
| Male | 53 | Prostate/Prostate | Normal | Adenocarcinoma of prostate | Gleason Score: 3 + 3 = 6/10 | 100 | 0 | 0 |
| Male | 65 | Prostate/Prostate | Normal | Adenocarcinoma of prostate | Gleason Score: 3 + 3 = 6/10 | 100 | 0 | 0 |
| Male | 48 | Prostate/Prostate | Normal | Adenocarcinoma of prostate | Gleason Score: 3 + 3 = 6/10 | 100 | 0 | 0 |
| Male | 68 | Prostate/Prostate | Normal | Adenocarcinoma of prostate | Gleason Score: 3 + 3 = 6/10 | 100 | 0 | 0 |
| Male | 76 | Prostate/Prostate | Normal | Adenocarcinoma of prostate | Gleason Score: 4 + 3 = 7/10 | 100 | 0 | 0 |
| Male | 60 | Prostate/Prostate | Lesion | Adenocarcinoma of prostate | Gleason Score: 3 + 3 = 6/10 | 0 | 100 | 0 |
| Male | 70 | Prostate/Prostate | Lesion | Carcinoma of bladder | AJCC G3: Poorly differentiated | 0 | 100 | 0 |
| Male | 74 | Prostate/Prostate | Lesion | Adenocarcinoma of prostate | Gleason Score: 3 + 3 = 6/10 | 0 | 100 | 0 |
| Male | 66 | Prostate/Prostate | Lesion | Adenocarcinoma of prostate | Gleason Score: 4 + 3 = 7/10 | 0 | 100 | 0 |
| Male | 72 | Prostate/Prostate | Lesion | Adenocarcinoma of prostate | Gleason Score: 3 + 4 = 7/10 | 0 | 0 | 100 |
| Male | 63 | Prostate/Prostate | Lesion | Adenocarcinoma of prostate | Gleason Score: 3 + 4 = 7/10 | 25 | 75 | 0 |
| Male | 55 | Prostate/Prostate | Lesion | Adenocarcinoma of prostate | Gleason Score: 3 + 4 = 7/10 | 0 | 100 | 0 |
| Male | 70 | Prostate/Prostate | Lesion | Adenocarcinoma of prostate | Gleason Score: 3 + 4 = 7/10 | 0 | 100 | 0 |
| Male | 68 | Prostate/Prostate | Lesion | Adenocarcinoma of prostate | Gleason Score: 3 + 3 = 6/10 | 0 | 100 | 0 |
| Male | 66 | Prostate/Prostate | Lesion | Adenocarcinoma of prostate | Gleason Score: 2 + 2 = 4/10 | 0 | 100 | 0 |
| Male | 76 | Prostate/Prostate | Lesion | Adenocarcinoma of prostate | Not Reported | 0 | 100 | 0 |
| Male | 71 | Prostate/Prostate | Lesion | Adenocarcinoma of prostate | Gleason Score: 3 + 4 = 7/10 | 0 | 100 | 0 |
| Male | 56 | Prostate/Prostate | Lesion | Adenocarcinoma of prostate | Gleason Score: 3 + 4 = 7/10 | 0 | 100 | 0 |
| Male | 61 | Prostate/Prostate | Lesion | Adenocarcinoma of prostate | Gleason Score: 4 + 3 = 7/10 | 0 | 100 | 0 |
| Male | 63 | Prostate/Prostate | Tumor | Adenocarcinoma of prostate | Gleason Score: 3 + 4 = 7/10 | 25 | 15 | 60 |
| Male | 70 | Prostate/Prostate | Tumor | Adenocarcinoma of prostate | Gleason Score: 3 + 3 = 6/10 | 25 | 5 | 70 |
| Male | 68 | Prostate/Prostate | Tumor | Adenocarcinoma of prostate | Gleason Score: 3 + 3 = 6/10 | 30 | 0 | 65 |
| Male | 61 | Prostate/Prostate | Tumor | Adenocarcinoma of prostate | Gleason Score: 3 + 3 = 6/10 | 10 | 0 | 70 |
| Male | 59 | Prostate/Prostate | Tumor | Adenocarcinoma of prostate | Gleason Score: 4 + 5 = 9/10 | 10 | 0 | 80 |
| Male | 61 | Prostate/Prostate | Tumor | Adenocarcinoma of prostate | Gleason Score: 3 + 4 = 7/10 | 5 | 0 | 85 |
| Male | 63 | Prostate/Prostate | Tumor | Adenocarcinoma of prostate | Gleason Score: 3 + 4 = 7/10 | 5 | 0 | 80 |
| Male | 53 | Prostate/Prostate | Lesion | Adenocarcinoma of prostate | Gleason Score: 4 + 3 = 7/10 | 0 | 100 | 0 |
| Male | 66 | Prostate/Prostate | Lesion | Adenocarcinoma of prostate | Gleason Score: 3 + 5 = 8/10 | 0 | 100 | 0 |
| Male | 61 | Prostate/Prostate | Lesion | Adenocarcinoma of prostate | Gleason Score: 4 + 3 = 7/10 | 0 | 100 | 0 |
| Male | 65 | Prostate/Prostate | Lesion | Adenocarcinoma of prostate | Gleason Score: 4 + 4 = 8/10 | 0 | 100 | 0 |
| Male | 64 | Prostate/Prostate | Lesion | Adenocarcinoma of prostate | Gleason Score: 3 + 4 = 7/10 | 0 | 100 | 0 |
| Male | 48 | Prostate/Prostate | Tumor | Adenocarcinoma of prostate | Gleason Score: 4 + 5 = 9/10 | 5 | 0 | 75 |
| Male | 65 | Prostate/Prostate | Tumor | Adenocarcinoma of prostate | Gleason Score: 4 + 4 = 8/10 | 0 | 0 | 90 |
| Male | 61 | Prostate/Prostate | Tumor | Adenocarcinoma of prostate | Gleason Score: 4 + 4 = 8/10 | 10 | 0 | 80 |
| Male | 51 | Prostate/Prostate | Lesion | Carcinoma of bladder, urothelial | AJCC G4: Undifferentiated | 0 | 100 | 0 |
| Male | 76 | Prostate/Prostate | Lesion | Hyperplasia of prostate, atypical | NULL | 0 | 100 | 0 |
| Male | 62 | Prostate/Prostate | Lesion | Hyperplasia of prostate | NULL | 0 | 100 | 0 |
| Male | 72 | Prostate/Prostate | Lesion | Hyperplasia of prostate | NULL | 0 | 100 | 0 |
| Male | 71 | Prostate/Prostate | Lesion | Hyperplasia of prostate | NULL | 0 | 100 | 0 |
| Male | 76 | Prostate/Prostate | Lesion | Glandular hyperplasia of prostate | NULL | 0 | 100 | 0 |
| Male | 71 | Prostate/Prostate | Lesion | Hyperplasia of prostate | NULL | 0 | 100 | 0 |
| Male | 76 | Prostate/Prostate | Lesion | Hyperplasia of prostate | NULL | 45 | 55 | 0 |
| Male | 76 | Prostate/Prostate | Lesion | Hyperplasia of prostate | NULL | 0 | 100 | 0 |
| Male | 56 | Prostate/Prostate | Lesion | Hyperplasia of prostate | NULL | 0 | 100 | 0 |
| Male | 85 | Prostate/Prostate | Lesion | Adenoma of prostate | NULL | 0 | 100 | 0 |
| Male | 72 | Prostate/Prostate | Lesion | Hyperplasia of prostate | NULL | 0 | 100 | 0 |

TABLE 2

Origene's Human Prostate Cancer Tissue panel II (HPRT502, Origene Inc)

| gender | age | tissue | appearance | sample diagnosis from pathology verification | tumor grade | normal | lesion | tumor |
|---|---|---|---|---|---|---|---|---|
| Male | 53 | Prostate/Prostate | Normal | Within normal limits | Not Applicable | 100 | 0 | 0 |
| Male | 48 | Prostate/Prostate | Normal | Within normal limits | Not Applicable | 100 | 0 | 0 |
| Male | 68 | Prostate/Prostate | Normal | Within normal limits | Not Applicable | 100 | 0 | 0 |
| Male | 76 | Prostate/Prostate | Normal | Within normal limits | Not Applicable | 100 | 0 | 0 |
| Male | 53 | Prostate/Prostate | Normal | Within normal limits | Not Applicable | 100 | 0 | 0 |
| Male | 68 | Prostate/Prostate | Normal | Within normal limits | Not Applicable | 100 | 0 | 0 |
| Male | 74 | Prostate/Prostate | Normal | Within normal limits | Not Applicable | 100 | 0 | 0 |
| Male | 72 | Prostate/Prostate | Normal | Within normal limits | Not Applicable | 100 | 0 | 0 |
| Male | 62 | Prostate/Prostate | Tumor | Adenocarcinoma of prostate | Gleason Score: 3 + 3 = 6/10 | 50 | 0 | 50 |
| Male | 54 | Prostate/Prostate | Tumor | Adenocarcinoma of prostate | Gleason Score: 3 + 3 = 6/10 | 20 | 0 | 60 |
| Male | 56 | Prostate/Prostate | Tumor | Adenocarcinoma of prostate | Gleason Score: 3 + 4 = 7/10 | 0 | 25 | 75 |
| Male | 56 | Prostate/Prostate | Tumor | Adenocarcinoma of prostate | Gleason Score: 3 + 3 = 6/10 | 10 | 0 | 90 |
| Male | 55 | Prostate/Prostate | Tumor | Adenocarcinoma of prostate | Gleason Score: 3 + 4 = 7/10 | 45 | 0 | 40 |
| Male | 63 | Prostate/Prostate | Tumor | Adenocarcinoma of prostate | Gleason Score: 3 + 4 = 7/10 | 20 | 0 | 80 |
| Male | 53 | Prostate/Prostate | Tumor | Adenocarcinoma of prostate | Gleason Score: 3 + 3 = 6/10 | 40 | 0 | 60 |
| Male | 64 | Prostate/Prostate | Tumor | Adenocarcinoma of prostate | Gleason Score: 3 + 4 = 7/10 | 0 | 0 | 90 |
| Male | 68 | Prostate/Prostate | Tumor | Adenocarcinoma of prostate | Gleason Score: 3 + 4 = 7/10 | 0 | 0 | 95 |
| Male | 63 | Prostate/Prostate | Tumor | Adenocarcinoma of prostate | Gleason Score: 3 + 3 = 6/10 | 60 | 0 | 40 |
| Male | 66 | Prostate/Prostate | Tumor | Adenocarcinoma of prostate | Gleason Score: 3 + 4 = 7/10 | 0 | 5 | 60 |
| Male | 70 | Prostate/Prostate | Tumor | Adenocarcinoma of prostate | Gleason Score: 3 + 4 = 7/10 | 25 | 0 | 65 |
| Male | 65 | Prostate/Prostate | Tumor | Adenocarcinoma of prostate | Gleason Score: 3 + 4 = 7/10 | 0 | 30 | 70 |
| Male | 64 | Prostate/Prostate | Tumor | Adenocarcinoma of prostate | Gleason Score: 3 + 3 = 6/10 | 0 | 0 | 90 |
| Male | 54 | Prostate/Prostate | Tumor | Adenocarcinoma of prostate | Gleason Score: 4 + 3 = 7/10 | 30 | 0 | 40 |
| Male | 64 | Prostate/Prostate | Tumor | Adenocarcinoma of prostate | Gleason Score: 3 + 4 = 7/10 | 0 | 0 | 80 |
| Male | 62 | Prostate/Prostate | Tumor | Adenocarcinoma of prostate | Gleason Score: 4 + 3 = 7/10 | 0 | 0 | 95 |
| Male | 62 | Prostate/Prostate | Tumor | Adenocarcinoma of prostate | Gleason Score: 4 + 3 = 7/10 | 0 | 0 | 90 |
| Male | 61 | Prostate/Prostate | Tumor | Adenocarcinoma of prostate | Gleason Score: 3 + 4 = 7/10 | 0 | 0 | 90 |
| Male | 62 | Prostate/Prostate | Tumor | Adenocarcinoma of prostate | Gleason Score: 3 + 5 = 8/10 | 0 | 0 | 80 |
| Male | 53 | Prostate/Prostate | Tumor | Adenocarcinoma of prostate | Gleason Score: 3 + 4 = 7/10 | 0 | 0 | 90 |
| Male | 58 | Prostate/Prostate | Tumor | Adenocarcinoma of prostate | Gleason Score: 4 + 3 = 7/10 | 0 | 0 | 90 |
| Male | 57 | Prostate/Prostate | Tumor | Adenocarcinoma of prostate | Gleason Score: 4 + 5 = 9/10 | 0 | 60 | 40 |
| Male | 65 | Prostate/Prostate | Tumor | Adenocarcinoma of prostate | Gleason Score: 3 + 3 = 6/10 | 0 | 55 | 45 |
| Male | 53 | Prostate/Prostate | Tumor | Adenocarcinoma of prostate | Gleason Score: 3 + 3 = 6/10 | 0 | 0 | 95 |
| Male | 61 | Prostate/Prostate | Tumor | Adenocarcinoma of prostate | Gleason Score: 3 + 4 = 7/10 | 0 | 0 | 90 |
| Male | 73 | Prostate/Prostate | Tumor | Adenocarcinoma of prostate | Gleason Score: 3 + 4 = 7/10 | 0 | 0 | 90 |
| Male | 52 | Prostate/Prostate | Tumor | Adenocarcinoma of prostate | Gleason Score: 4 + 4 = 8/10 | 0 | 0 | 85 |
| Male | 64 | Prostate/Prostate | Tumor | Adenocarcinoma of prostate | Gleason Score: 4 + 3 = 7/10 | 0 | 0 | 90 |
| Male | 54 | Prostate/Prostate | Tumor | Adenocarcinoma of prostate | Gleason Score: 5 + 4 = 9/10 | 0 | 0 | 90 |
| Male | 61 | Prostate/Prostate | Tumor | Adenocarcinoma of prostate | Gleason Score: 3 + 2 = 5/10 | 20 | 0 | 80 |
| Male | 61 | Prostate/Prostate | Lesion | Hyperplasia of prostate | Gleason Score: 4 + 3 = 7/10 | 0 | 100 | 0 |
| Male | 54 | Prostate/Prostate | Tumor | Adenocarcinoma of prostate | Gleason Score: 4 + 3 = 7/10 | 0 | 0 | 80 |
| Male | 62 | Prostate/Lymph node | Tumor | Adenocarcinoma of prostate, metastatic | Not Reported | 0 | 0 | 95 |
| Male | 64 | Prostate/Prostate | Tumor | Adenocarcinoma of prostate | Gleason Score: 4 + 3 = 7/10 | 0 | 0 | 90 |
| Male | 87 | Prostate/Prostate | Tumor | Adenocarcinoma of prostate | Gleason Score: 5 + 4 = 9/10 | 0 | 0 | 80 |
| Male | 76 | Prostate/Prostate | Tumor | Adenocarcinoma of prostate | Gleason Score: 3 + 4 = 7/10 | 0 | 0 | 90 |
| Male | 71 | Prostate/Prostate | Tumor | Adenocarcinoma of prostate | Gleason Score: 2 + 3 = 5/10 | 0 | 0 | 80 |
| Male | 77 | Prostate/Prostate | Tumor | Adenocarcinoma of prostate | Gleason Score: 4 + 4 = 8/10 | 10 | 0 | 90 |
| Male | 83 | Prostate/Prostate | Tumor | Adenocarcinoma of prostate | Gleason Score: 5 + 4 = 9/10 | 40 | 0 | 60 |

The Origene's Human Prostate Cancer Tissue panels I and II used for the experiments described in the following comprises samples which are all derived from male patients (ages 48-87). The column "tissue" defines the tissue that has been taken during surgery. The column "appearance" indicates the pathological status of the tissue section that was used to isolate RNA, and that was finally used for qPCR measurements. "Normal" in that context means normal, adjacent tissue (NAT), which is a tissue taken from surgical material (commonly, by Radical Prostatectomy or TURP (Trans Urethral Resection of the Prostate)) but which appears with normal/healthy morphology and histology and is therefore used as a control. The definition of "Lesion" is as follows: Non-neoplastic tissue that is not normal, in that there is some type of pathological diagnostic abnormality (but no tumor). This includes histopathologies such as inflammation or benign hyperplasia (examples: Colitis, Crohn's disease, Endometriosis, Emphysema, Bronchitis). "Tumor" is defined as neoplastic tissue that could either be benign or malignant based on pathology diagnosis (e.g. Adenoma, Adenocarcinoma, Sarcoma). The column "diagnosis" describes the scheduled reason for surgery (e.g., bladder cancer for patient 9, but prostate cancer tissue was taken as well). Column "tumor grade" describes the Gleason Score if applicable (i.e., in case of tumor tissue). Columns "normal", "lesion", and "tumor" define the percentage of corresponding tissue found in histology within the tissue section used for RNA isolation. Origene's Human Prostate Cancer Tissue panel 1 includes 7 normal samples (normal adjacent tissue, NAT), 11 hyperplasia samples (BPH—Benign prostate hyperplasia), 20 lesion samples, and 10 prostate tumor samples. Of the tumor samples, 7 are from tumors that had a Gleason score of 7 or higher. Origene's Human Prostate Cancer Tissue panel II includes 8 normal samples (normal adjacent tissue), 1 hyperplasia sample (BPH—Benign prostate hyperplasia), and 39 prostate tumor samples. Of the tumor samples, 10 originate from donors ranked with Gleason score of up to 6, and 29 are from tumors that had a Gleason score of 7 or higher.

Primer sequences used for human PDE4D5:

```
sense primer sequence:
                                    (SEQ ID NO: 7)
GCAGCATGAGAAGTCCAAGA, antisense primer sequence:
                                    (SEQ ID NO: 8)
TGTATGTGCCACCGTGAAAC probe sequence:
                                    (SEQ ID NO: 9)
TCGGTTTCTCCCAAGCTCTCTCCAGTGATAAACCGA.
(FAM-labeled)
```

Primer sequences used for human PDE4D7:

```
sense primer sequence:
                                    (SEQ ID NO: 10)
CGGAATGGAACCCTA TCTTGTC;

antisense primer sequence:
                                    (SEQ ID NO: 11)
TTGGTCGTTGAATGTTCTCTGAT;

probe sequence:
                                    (SEQ ID NO: 12)
CCTCTCGCCTTCAGACAGTTGGAACAAGGAGAGG.
(FAM-labeled)
```

The PDE4D7 and PDE4D5 specific primers (SEQ ID NOs: 7, 8, 10 and 11) were premixed with the FAM probes to perform quantitative, real-time PCR (qPCR), and used in a 1:20 dilution according to manufacturer's description (PrimerDesign, UK). The human cDNA samples (see Tables 1 and 2) were arranged in standard, qPCR-ready, 96-well microtiter (MT) plates. 48 tissue samples, derived from 48 different patients, were arranged per 96-well MT plate, with each of the 48 wells used per plate containing ca 2-3 ng of RNA reverse transcribed cDNA.

The cDNA content of each well was normalized based on qPCR on a 'house-keeping' gene like beta-actin, GAPDH, beta-2-microglobulin, such that further normalization of cDNA content was not required.

To each of the used well of the MT plate 15 μL Applied Biosystems' GeneAmp mastermix (2×), 13.5 μL RNAse/DNAse free water and 2 μL PrimerDesign PerfectProbe primermix (PrimerDesign, UK) were added. All samples were analyzed with the following PCR protocol: 2 min at 50° C., 10 min at 95° C., 15 sec at 95° C., 30 sec at 50° C. while recording fluorescence, 15 sec at 72° C. and the last three steps repeated 50 times.

For all calculations relative gene expression values, the following procedure was used: $C_T$ values of 40 or higher or below 16 were excluded for poor quality reasons. (The genes examined here had an average $C_T$-value of ~31). To normalize the $C_T$ values across different qPCR plates, the median $C_T$ value of the "normal" tissue samples was calculated, and the relative expression values for the "lesion", "hyperplasia" as well as "tumor" samples relative to this value were determined by calculating the ratio between $C_T$ values of "lesion", "hyperplasia" as well as "tumor" samples and the $C_T$ value of "normal" tissue samples. Typically this resulted in relative expression values of ~1. In case the gene expression was analyzed multiple times (using multiple plates of the same panel), the relative expression values of each individual sample were averaged.

Relative Expression of Human PDE4D5 in Human Prostate Tissue

The gene expression level of the human PDE4D5 isoform was determined on human prostate tissues as described above. The relative expression levels were determined in four defined prostate tissues ("Normal", "Lesion", "Hyperplasia", "Tumor"). The expression levels for the groups "Lesion", "Hyperplasia", and "Tumor" were calculated as outlined above as a normalized value by forming the ratio of $C_T$ values for each individual patient tissue of groups "Lesion", "Hyperplasia", "Tumor" against the median $C_T$ value of the group "Normal". The same was done for each individual patient tissue of the group "Normal" such that the median expression value for this group is 1.

Figure 7:
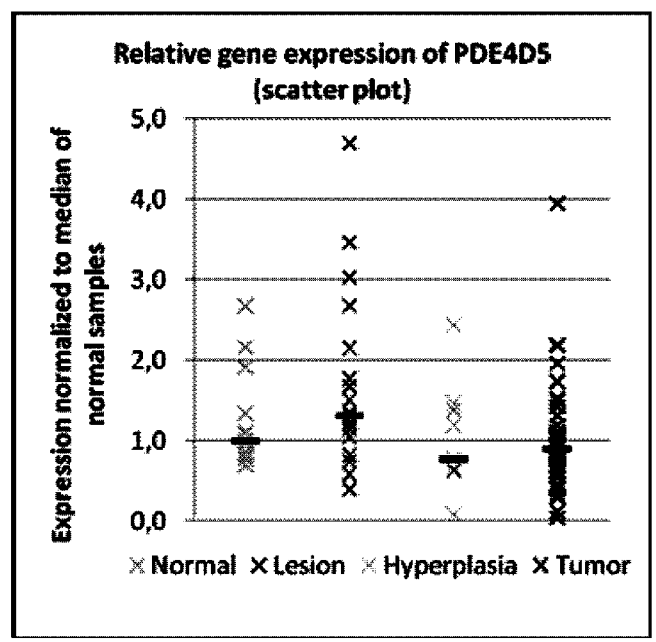
FIG. 7 shows the relative gene expression of human PDE4D5 in 96 different samples derived from Origene HPRT panels I and II. Indicated are the individual relative expression values for human PDE4D5 on human prostate tissues and the median of the data relative data measurements for each patient group.
Figure 8:
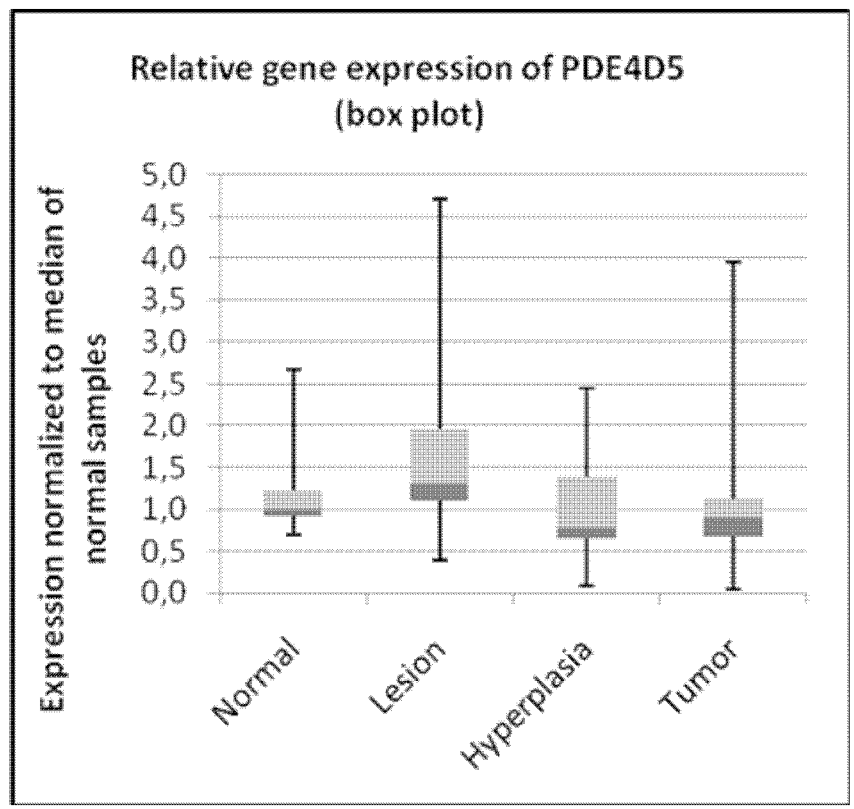
FIG. 8 shows the relative gene expression of human PDE4D5 in 96 different samples derived from Origene HPRT panels I and II. The figure shows a box plot of the individual data relative expression measurements for human PDE4D5, whereby the box includes 75% of all measurements. The median relative expression value is indicated as the border between the two colored boxes.

As can be derived from FIGS. 7 and 8, no significant different expression for human PDE4D5 could be detected for aberrant prostate tissues (Lesion, Hyperplasia, and Tumor) compared to normal prostate tissue. All p-values for comparison of aberrant but non-cancerous tissues (Lesion, Hyperplasia) vs. Tumor tissue were >0.5

Relative Expression of Human PDE4D7 in Human Prostate Tissue

The gene expression level of the human PDE4D7 isoform was determined on human prostate tissues as described above. The relative expression levels were determined in four defined prostate tissues ("Normal", "Lesion", "Hyperplasia", "Tumor"). The depicted expression levels for the groups "Lesion", "Hyperplasia", and "Tumor" were calculated as outlined above as a normalized value by forming the ratio of $C_T$ values for each individual patient tissue of groups "Lesion", "Hyperplasia", "Tumor" against the median $C_T$ value of the group "Normal". The same was done for each individual patient tissue of the group "Normal" such that the median expression value for this group is 1.

A Student's t-test was performed to see whether human PDE4D7 gene expression is on average significantly elevated in different tumor tissues compared against normal prostate tissue. The p-values derived from different pair-wise comparisons were: T-test of Benign (Lesion+Hyperplasia) vs. Tumor: p=0.0035; T-test of Normal vs. Tumor: p=0.092; T-test of Hyperplasia vs. Tumor: p=0.040; and T-test of Lesion vs. Tumor: p=0.031.

Figure 9:
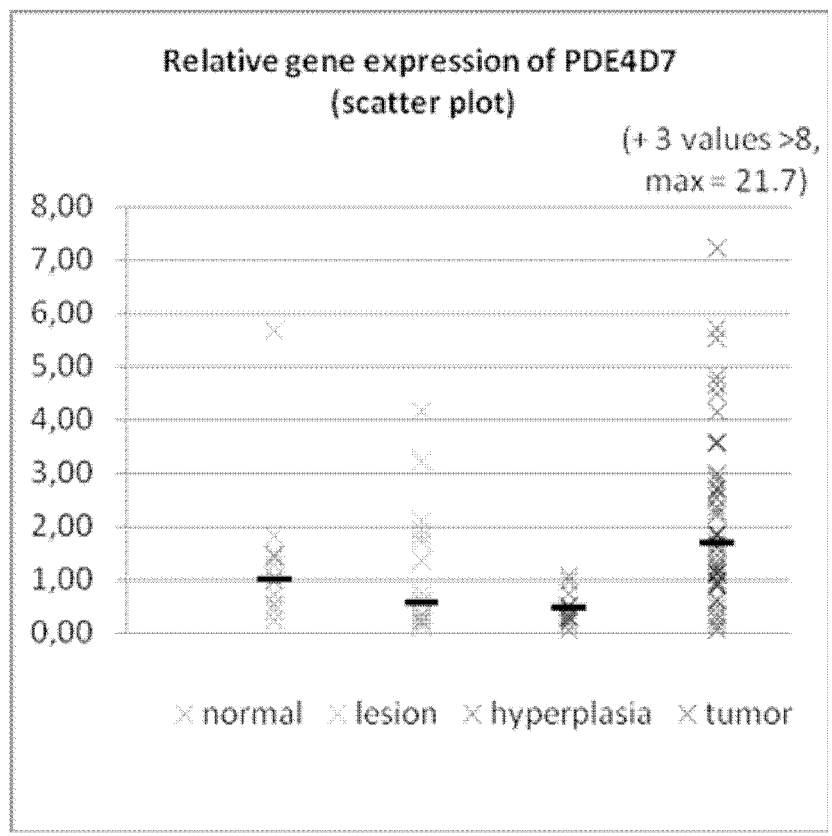
FIG. 9 shows the relative gene expression of PDE4D7 in 96 different samples derived from Origene HPRT panels I and II. Indicated are the individual relative expression values for human PDE4D7 on human prostate tissues and the median of the data relative data measurements is indicated for each patient group.
Figure 10:
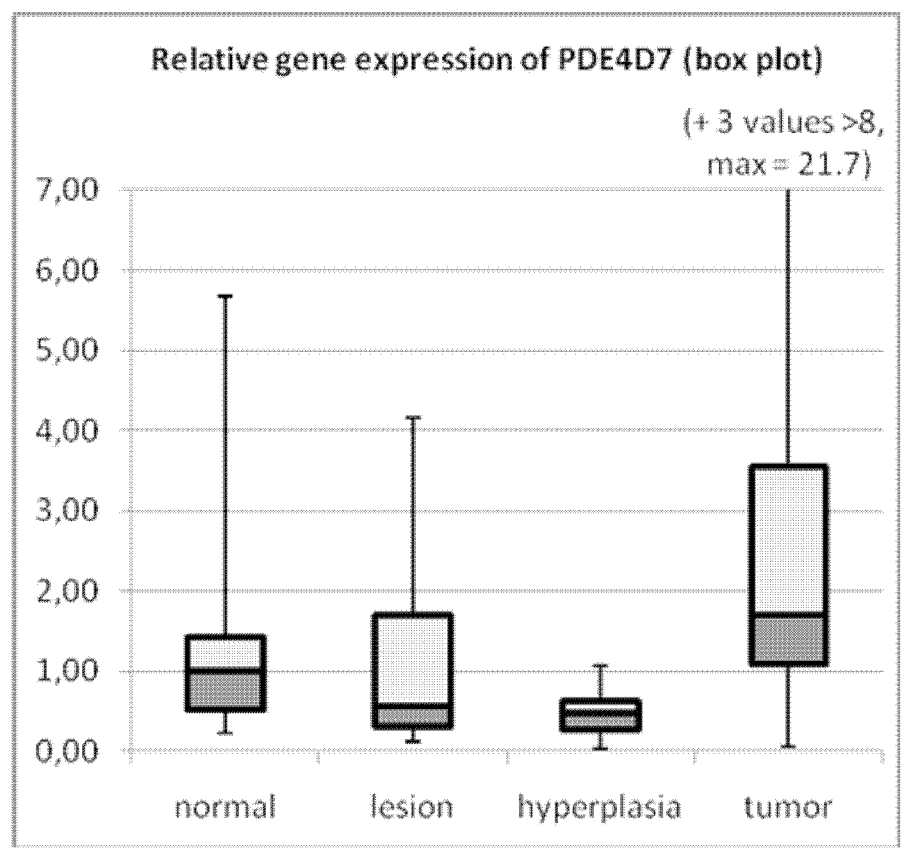
FIG. 10 shows the relative gene expression of PDE4D7 in 96 different samples derived from Origene HPRT panels I and II. The figure shows a box plot of the individual data relative expression measurements for human PDE4D7, whereby the box includes 75% of all measurements. The median relative expression value is indicated as the border between the two grey-colored boxes.

As can be derived from FIGS. 9 and 10 and the indicated p-values, a significant different expression for human PDE4D7 could be detected for aberrant prostate tissues (Lesion, Hyperplasia) compared to malignant prostate tissue.

Receiver-Operator-Curve (ROC) Analysis of PDE4D7 Expression

Figure 11:
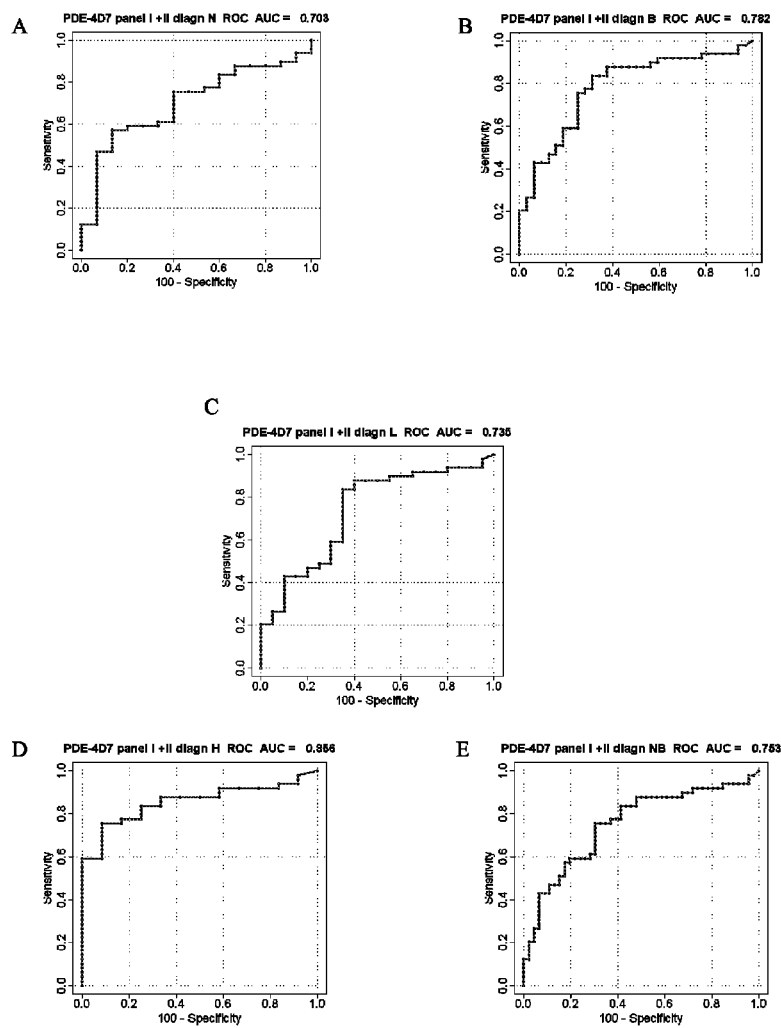
FIG. 11 shows the ROC curve representations of the PDE4D7 gene expression on human prostate tissue samples indicating AUC for different pair-wise comparisons.

Subsequently, a Receiver-Operator-Curve (ROC) analysis was performed to determine the AUC (Area Under Curve) for different pair-wise comparisons. The Receiver Operating Characteristic curves of PDE-4D7 gene expression to assess diagnostic power are shown in FIG. 11. The ROC analysis provided evidence that the differentiation between benign and malignant prostate tissue based on PDE4D7 expression levels is possible with a specificity (False Positive Rate) of >80% at sensitivity (False-Negative Rate) levels of ~80%.

The Prostate PDE-Index (PPI)—Relative Expression of Human PDE4D7 in Human Prostate Tissue Normalized Against Human PDE4D5 to Effectively Discriminate Between Benign and Malignant Prostate Diseases The gene expression level of the human PDE4D7 and human PDE4D5 isoforms were determined on human prostate tissues as described above. The relative expression levels were determined in four defined prostate tissues ("Normal", "Lesion", "Hyperplasia", "Tumor"). The relative expression level of PDE4D7 was calculated by subtracting the individual $C_T$ values PDE4D7 from the individual $C_T$ values for PDE4D5. Typically, this leads to a distribution of the "Normal" expression values around 0 (between −2 and +2). Further, the optimal cutoff value between non-tumor ("Normal", "Lesion", "Hyperplasia") and tumor ("Tumor") samples is such between −1 and +1.

This approach advantageously allows the comparison of PDE4D7 $C_T$ values against an internal control, namely PDE4D5. It is therefore not necessary to normalize samples of relevant clinical patient groups against a number of normal samples that may not always be available in a real testing setting. This test can be run as s simple assay with human PDE4D5 as an internal reference control to form the Prostate PDE-Index which is defined as delta(Ct[human PDE4D5]−Ct[human PDE4D7]).

The Prostate PDE-Index was experimentally performed such that the most optimal cutoff for the discrimination between malignant and benign prostate diseases is between −2 and +2, preferably 0 (zero). The assay cutoff value can be established based on historical data measured on retrospectively collected clinical samples. The interpretation of the PPI is such that any positive value leads to an increased risk for the presence of a malignant tumor in a patient, whereas any negative value leads to a decreased risk for the presence of a malignancy but rather indicates the presence of a non-malignant lesion in the prostate.

A Student's T-test is performed to determine the statistical significance for difference of the mean expression values between different clinical patient groups. The Student's T-test indicates that the chance of mean value of the groups "Lesion+Hyperplasia" is different by chance is p=2.28E-11. For discrimination between the Groups "Normal" and "Tumor" p=0.0003.

Figure 12:
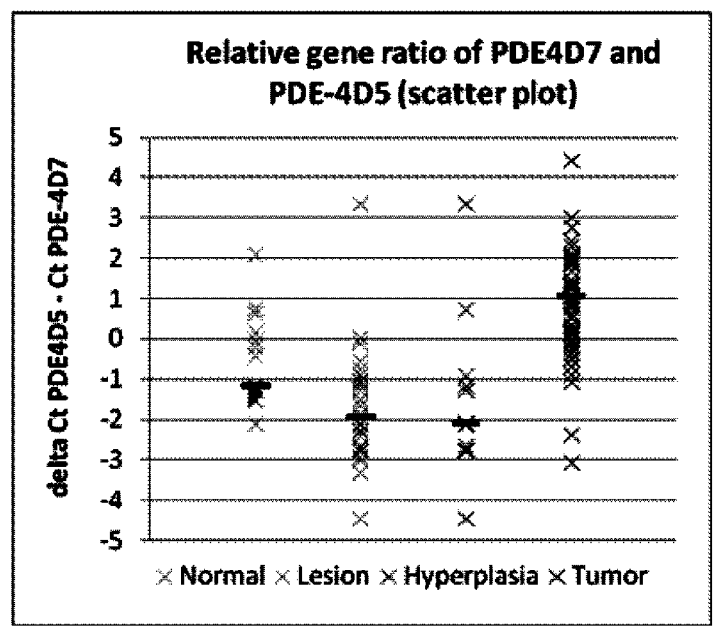
FIG. 12 shows the relative gene expression ratio of PDE4D7 and PDE4D5 (delta(Ct[human PDE4D5]–Ct[human PDE4D7])). Ct values of human PDE4D7 were subtracted from Ct values of human PDE4D5 for each individual tissue sample tested. Information was derived from 96 different samples in total, measured on Origene HPRT panels I and II (see Examples). The Fig. shows individual relative expression values for human delta (PDE4D5-PDE4D7) on human prostate tissues. The median of the data relative data measurements is indicated for each patient group.
Figure 13:
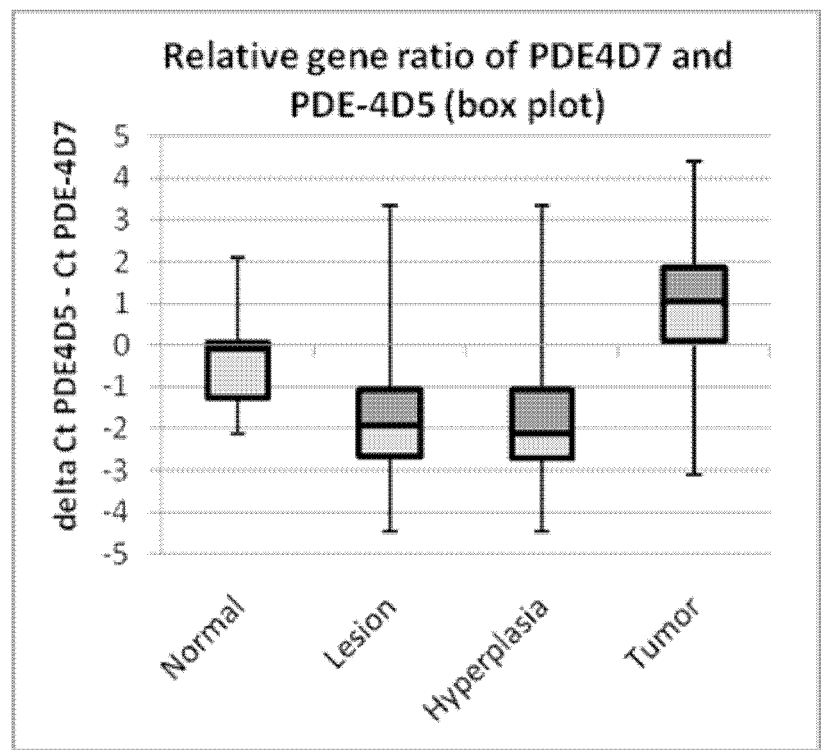
FIG. 13 shows the relative gene expression ratio of PDE4D7 and PDE4D5 (delta(Ct[human PDE4D5]–Ct[human PDE4D7])). Ct values of human PDE4D7 were subtracted from Ct values of human PDE4D5 for each individual tissue sample tested. Information was derived from 96 different samples in total, measured on Origene HPRT panels I and II (see Examples). The Fig. indicates a box plot of the individual data relative expression measurements for human delta (PDE4D5-PDE4D7), whereby the box includes 75% of all measurements. The median relative expression value is indicated as the border between the two grey-colored boxes.

As can be derived from FIGS. 12 and 13 and the indicated p-values, a very significant different expression for human PDE4D7 could be detected for aberrant prostate tissues (Lesion, Hyperplasia) compared to malignant prostate tissue.

Receiver-Operator-Curve (ROC) Analysis of PDE4D7 Expression

Figure 14:
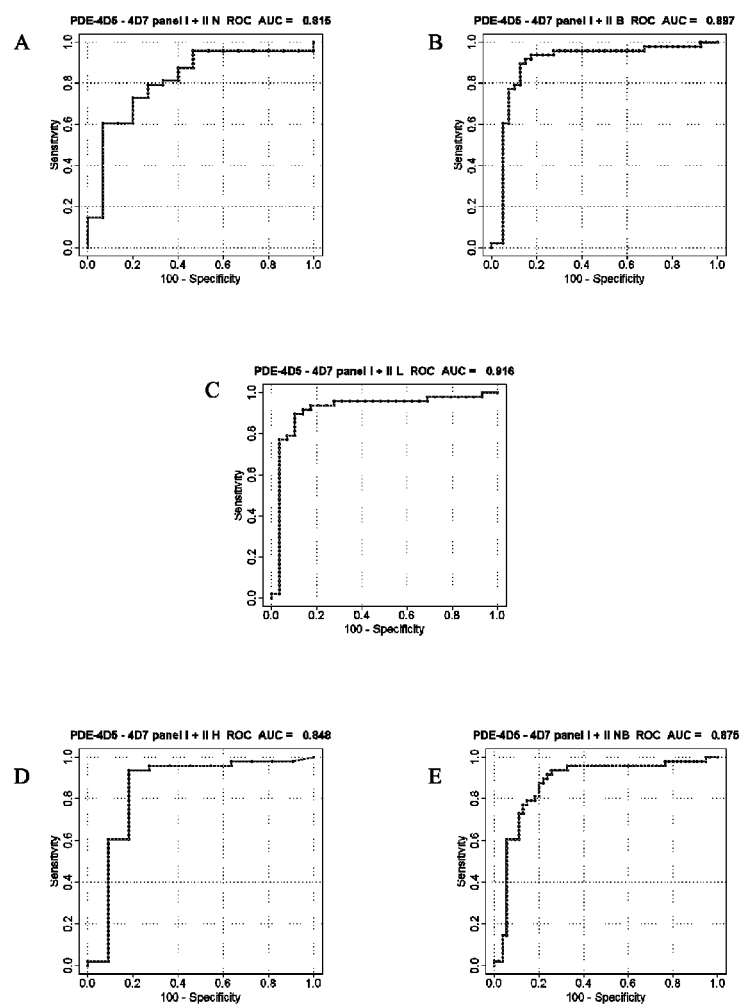
FIG. 14 shows Receiver Operating Characteristics curves of delta(Ct[human PDE4D5]–Ct[human PDE4D7]) gene expression values to assess diagnostic power. The Fig. indicates the ROC curve representations of the Prostate PDE-Index on human prostate tissue samples indicating AUC for different pair-wise comparisons.

Subsequently, a Receiver-Operator-Curve (ROC) analysis was performed to determine the AUC (Area Under Curve) for different pair-wise comparisons. The Receiver Operating Characteristic curves of PDE-4D7 gene expression to assess diagnostic power are shown in FIG. 14. The ROC analysis provided evidence that the differentiation between benign and malignant prostate tissue based on the Prostate PDE-Index is possible with a specificity (False Positive Rate) of >80% at sensitivity (False-Negative Rate) levels of ~80%.

The Prostate PDE-Index Assay—Multiplex qPCR Assay of Human PDE4D5 and Human PDE4D7

To simplify the testing procedure to determine the PPI from the expression of both PDE4D5 and PDE4D7 a multiplex assay to determine the $C_T$ values for both genes in a single qPCR reaction was developed.

The same primers and probes for human PDE4D5 and PDE4D7 as above were used, the only change being a different fluorescent label of the probe for human PDE4D5. In particular, the FAM dye of the probe was exchanged against a Cy5 dye (with maximal emission at 670 nm, vs. a maximal emission at 518 nm of FAM) to be able to measure both genes in a single multiplex qPCR assay. PDE4D5 and PDE4D7 primers were obtained from PrimerDesign, UK and delivered with the probes premixed.

the ratio of 1:1.5 of PDE4D5:PDE4D7 was found to work optimally for pre-mixed primer/probes assays. We accordingly added 1 and 1.5 µL of the pre-mixed primer/probes assays respectively to the total PCR-mixture with a final assay volume of 30 µl.

The PCR procedure was performed according to manufacturer's instructions: 2 min at 50° C., 10 min at 95° C., 15 sec at 95° C., 30 sec at 50° C. while recording fluorescence (FAM & Cy5), 15 sec at 72° C. and the last three steps repeated 50 times.

A Student's T-test is performed to determine the statistical significance for difference of the mean expression values between different clinical patient groups. The Student's T-test indicates that the chance of mean value of the groups "Lesion+Hyperplasia" is different by chance is p=5.70E-06.

Figure 15:
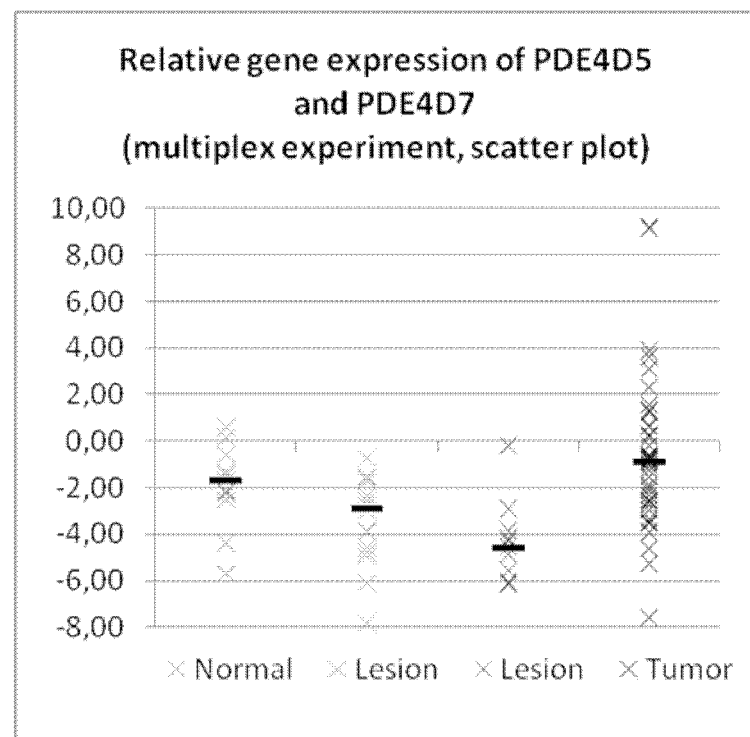
FIG. 15 depicts the results of a Multiplex Assay of relative gene expression of delta(Ct[human PDE4D5]–Ct[human PDE4D7]), performed in a single experiment. Ct's of PDE-4D7 were subtracted from Ct's of PDE-4D5. Information is derived from 96 different samples in total, measured in Origene HPRT panels I and II (see Examples). The Fig. shows individual relative expression values for delta(Ct[human PDE4D5]–Ct[human PDE4D7]) on human prostate tissues. The median of the data relative data measurements is indicated for each patient group.
Figure 16:
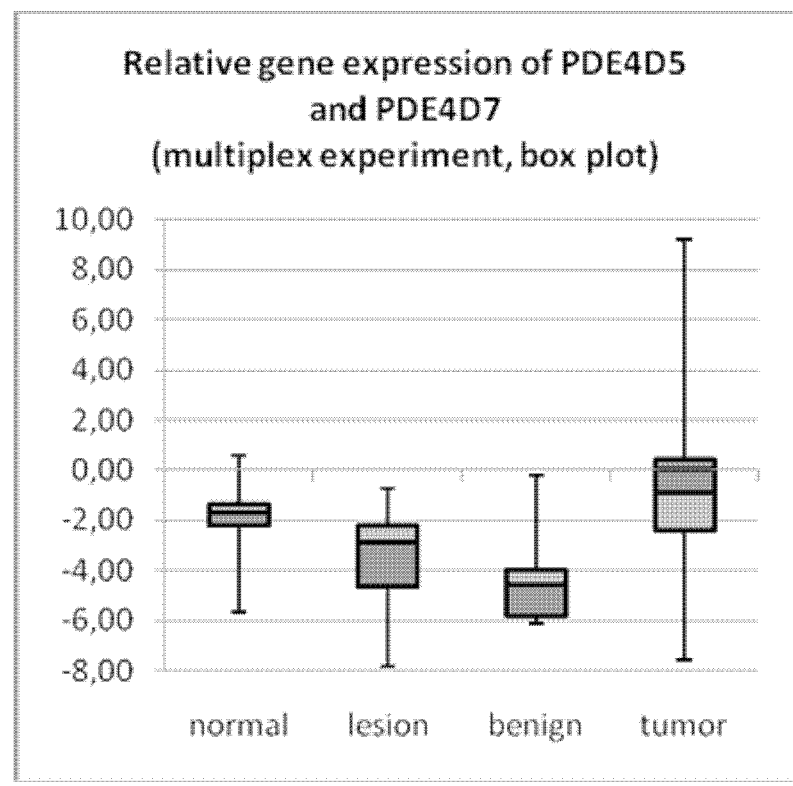
FIG. 16 depicts the results of a Multiplex Assay of relative gene expression of delta(Ct[human PDE4D5]–Ct[human PDE4D7]), performed in a single experiment. Ct's of PDE-4D7 were subtracted from Ct's of PDE-4D5. Information is derived from 96 different samples in total, measured in Origene HPRT panels I and II (see Examples). The Fig. indicates a box plot of the individual data relative expression measurements for delta(Ct[human PDE4D5]–Ct[human PDE4D7]), whereby the box includes 75% of all measurements. The median relative expression value is indicated as the border between the two grey-colored boxes.

As can be derived from FIGS. 15 and 16 and the indicated p-values, a very significant different expression for human PDE4D7 could be detected for aberrant prostate tissues (Lesion, Hyperplasia) compared to malignant prostate tissue based on the measurement of the multiplex assay to determine the Prostate PDE Index.

Receiver-Operator-Curve (ROC) Analysis of PDE4D7 Expression

Figure 17:
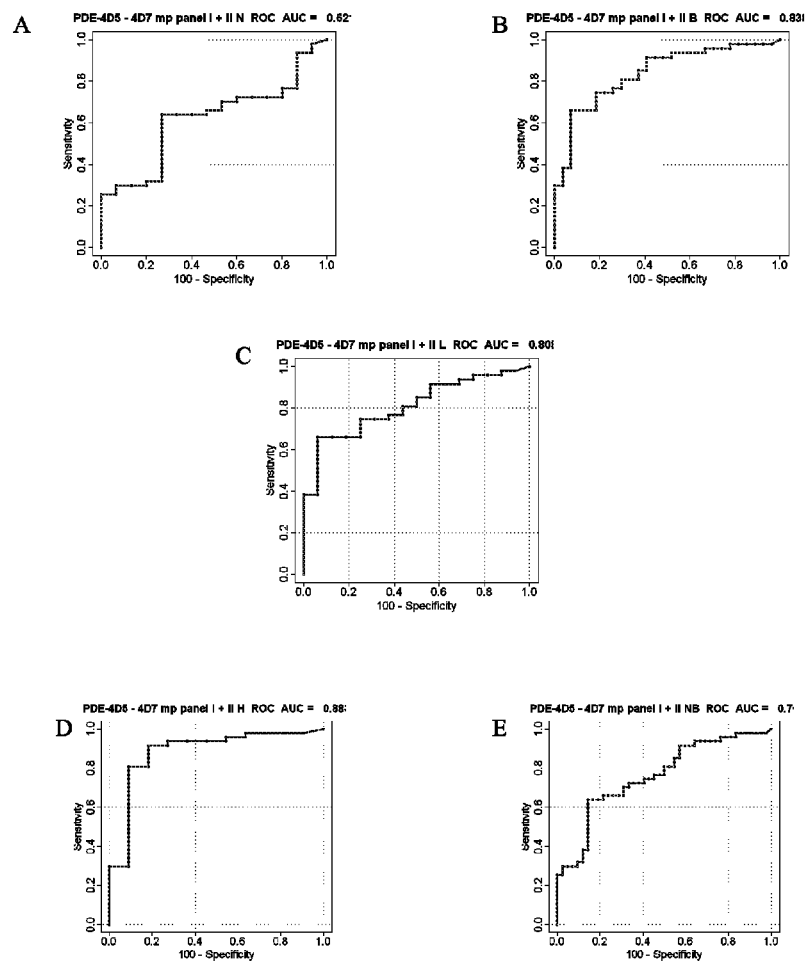
FIG. 17 shows Receiver Operating Characteristic curves of the PDE-Index Multiplex Assay (PIMA) defined as delta(Ct[human PDE4D5]–Ct[human PDE4D7]). The Fig. indicates the ROC curve representations of the Prostate PDE-Index on human prostate tissue samples indicating AUC for different pair-wise comparisons.

Subsequently, a Receiver-Operator-Curve (ROC) analysis was performed to determine the AUC (Area Under Curve) for different pair-wise comparisons. The Receiver Operating Characteristic curves of PDE-4D7 gene expression to assess diagnostic power are shown in FIG. 17. The ROC analysis provided evidence that the differentiation between benign and malignant prostate tissue based on the Prostate PDE-Index is possible with a specificity (False Positive Rate) of >80% at sensitivity (False-Negative Rate) levels of ~80%.

Example 3

The Effect of Rolipram on the Proliferation of Prostate Cancer Cells

Figure 18:
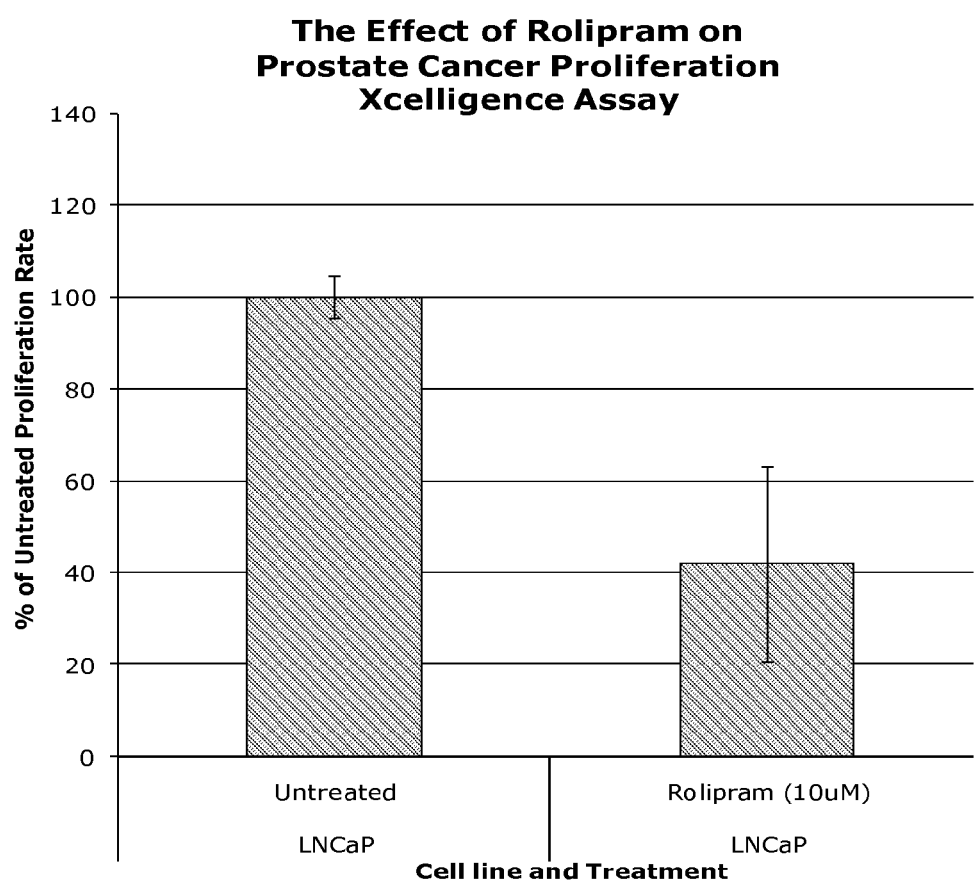
FIG. 18 shows an Xcelligence assay with LNCaP cells and the PDE4 inhibitor Rolipram. The growth data is expressed as a percentage of "untreated" slope value obtained during real time electrical impedance measurements. Measurements were conducted 12 hours after the initial plating down phase of the assay, i.e. 12 hours-60 hours—so as to examine proliferative potential and not morphological change. The cells were assayed without the presence of androgens.

For the Xcelligence assay LNCaP cells were grown at 37° C., 5% $CO_2$, from a seeding value of 5000 cells. The final plating volume was 200 µl. E-Plate 96 well plates were obtained from Roche (Cat No 05232368001). The growth data were obtained during real time electrical impedance measurements. Measurements were conducted 12 hours after the initial plating down phase of the assay, i.e. 12 hours-60 hours—so as to examine proliferative potential and not morphological change. The cells were assayed without the presence of androgens. The significance of differential growth rates were calculated using T-Test of Triplicate Values only. As can be derived from FIG. 18 the incubation of LNCaP prostate cancer cells with 10 uM of the PDE4 selective inhibitor Rolipram leads to a significant suppression (p<0.01) of cell proliferation in real-time measurement of cellular growth. The level of average inhibition of cell proliferation is around 50%, which would lead to an IC50 of the compound of ~10 µM. Compared to an in vitro IC50 for 50% inhibition of PDE4 in vitro of ~2 µm, an in vivo IC50 of 10 µM let us conclude that the proliferation inhibition effect is largely due to its PDE4 activity.

Figure 19:
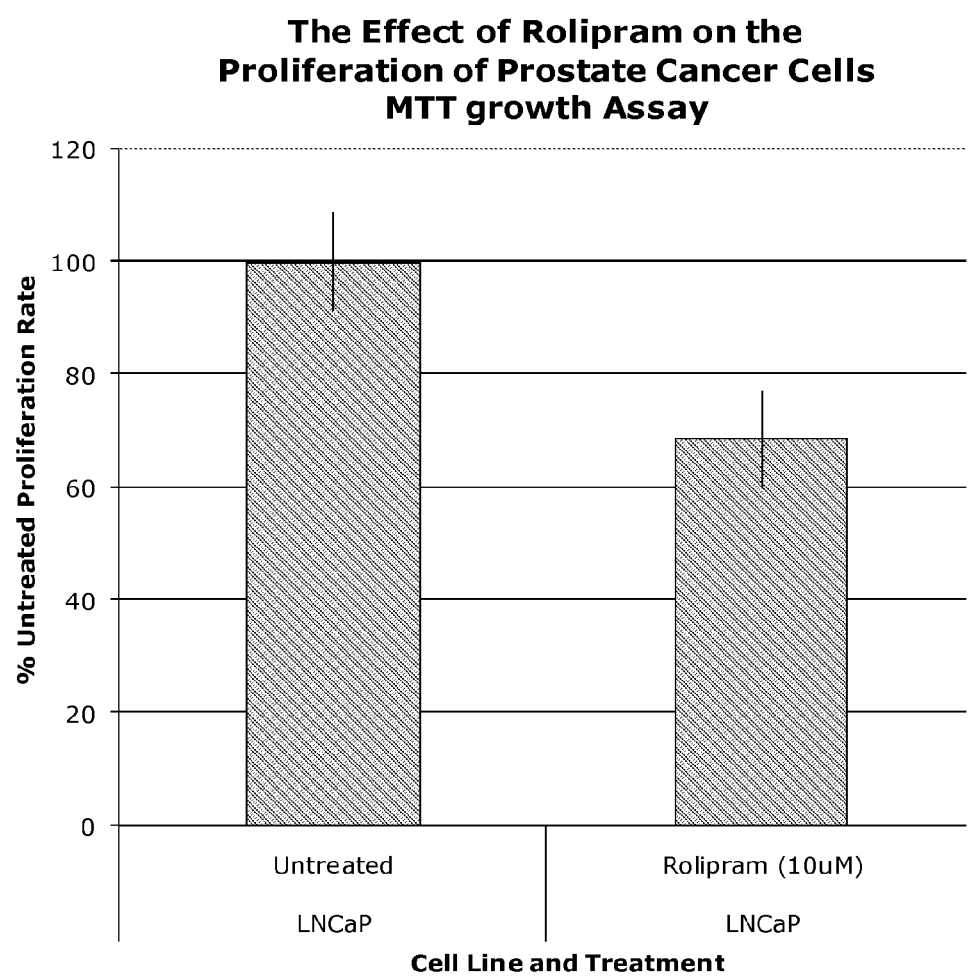
FIG. 19 shows an MTT growth assay with LNCaP cells and the PDE inhibitor Rolipram. The growth data is expressed as a percentage of as a percentage the "untreated" A590 Abs reading after 48 hours. The cells were assayed without the presence of androgens.

For the MTT growth assay LNCaP cells were grown at 37° C., 5% $CO_2$, from a seeding value of 5000 cells. The final plating volume was 200 µl. The proliferation assay was obtained from Promega (Cat no G3582). The growth data were obtained during A590 Abs measurements. Measurements were conducted 48 hours after the initial plating. The cells were assayed without the presence of androgens. The significance of final A590 readings was calculated using T-Test of Triplicate Values only. As can be derived from FIG. 19 the incubation of LNCaP prostate cancer cells with 10 µM of the PDE4 selective inhibitor Rolipram leads to a significant suppression (p<0.01) of cell proliferation in an end-point measurement of cellular growth. The level of average inhibition of cell proliferation is around 50%, which would lead to an IC50 of the compound of ~10 µM. Compared to an in vitro IC50 for 50% inhibition of PDE4 in vitro of ~2 um, an in vivo IC50 of 10 µM let us conclude that the proliferation inhibition effect is largely due to its PDE4 activity.

The application comprises the following additional embodiments:

Item 1: Phosphodiesterase 4D7 (PDE4D7) for use as a marker for malignant, hormone-sensitive prostate cancer, wherein the expression of the marker is increased when comparing the expression in malignant, hormone-sensitive prostate cancer tissue, to the expression in normal tissue or benign prostate tumor tissue.

Item 2: A composition for diagnosing, detecting, monitoring or prognosticating malignant, hormone-sensitive prostate cancer or the progression towards malignant, hormone-sensitive prostate cancer, comprising a nucleic acid affinity ligand and/or a peptide affinity ligand for the PDE4D7 expression product or protein.

Item 3: The composition of item 2, wherein said nucleic acid affinity ligand or peptide affinity ligand is modified to function as a contrast agent.

Item 4: The composition of item 2, wherein said affinity ligand is a set of oligonucleotides specific for the PDE4D7 expression product, a probe specific for the PDE4D7 expression product, an aptamer specific for the PDE4D7 expression product or for the PDE4D7 protein, an antibody specific for the PDE4D7 protein and/or an antibody variant specific for the PDE4D7 protein.

Item 5: Use of PDE4D7 as a marker for diagnosing, detecting, monitoring or prognosticating malignant, hormone-sensitive prostate cancer or the progression towards malignant, hormone-sensitive prostate cancer.

Item 6: A method for detecting, diagnosing, monitoring or prognosticating malignant, hormone-sensitive prostate cancer or the progression towards malignant, hormone-sensitive prostate cancer comprising at least the step of determining the level of PDE4D7 in a sample.

Item 7: The method of item 6, wherein the determining step is accomplished by the measurement of nucleic acid or protein levels or by the determination of the biological activity of PDE4D7.

Item 8: The method of item 7, wherein said method comprises the additional step of comparing the measured nucleic acid or protein levels or the measured biological activity to a control level.

Item 9: A method for diagnosing, monitoring or prognosticating malignant, hormone-sensitive prostate cancer or the progression towards malignant, hormone-sensitive prostate cancer, wherein said method discriminates between a benign and a malignant, hormone-sensitive prostate cancer, comprising the steps of (a) determining the level of PDE4D7 in a sample by the measurement of nucleic acid or protein level(s) or by the determination of the biological activity of PDE4D7, (b) determining the level of expression of a house-keeping gene in a sample by the measurement of nucleic acid or protein level(s) or by the determination of the biological activity of a house-keeping gene, preferably GAPDH;

(c) normalizing the measured nucleic acid or protein level(s) or the measured biological activity of PDE4D7 to the expression of the house-keeping gene, preferably GAPDH; and (d) comparing the normalized expression level with a predetermined cutoff value, wherein said cutoff value is between about 0.1 and 100, preferably about 4.7, chosen to exclude benign prostate tumor, wherein a normalized expression level above the cutoff value is indicative of a malignant, hormone-sensitive prostate cancer.

Item 10: A method of data acquisition comprising at least the steps of:

(a) testing in an individual for expression of PDE4D7; and (b) comparing the expression as determined in step (a) to a control level.

Item 11: The use of item 2 or the method of any one of items 6 to 10, wherein the diagnosing, detecting, monitoring, prognosticating or data acquisition is to be carried out on a sample obtained from an individual.

Item 12: An immunoassay for detecting, diagnosing, monitoring or prognosticating malignant, hormone-sensitive prostate cancer or the progression towards malignant, hormone-sensitive prostate cancer comprising at least the steps (a) testing in a sample obtained from an individual for the expression of PDE4D7, (b) testing in a control sample for the expression of PDE4D7, (c) determining the difference in expression of PDE4D7 of steps (a) and (b); and (d) deciding on the presence or stage of cancer or the progression of cancer based on the results obtained in step (c), wherein said testing steps are based on the use of an antibody specifically binding to PDE4D7.

Item 13: The use or method of item 11 or the immunoassay of item 12, wherein said sample is a tissue sample, a biopsy sample, a urine sample, a urine sediment sample, a blood sample, a saliva sample, a semen sample, or a sample comprising circulating tumor cells.

Item 14: A pharmaceutical composition comprising at least one element selected from the group of:

(a) a compound directly inhibiting the activity of PDE4D7, preferably an antagonist of PDE4D7 enzymatic activity;

(b) a compound indirectly inhibiting the activity of PDE4D7;

(c) a dominant negative form of the PDE4D7 protein or a biologically active equivalent thereof;

(d) a nucleic acid encoding and expressing a dominant negative form of PDE4D7;

(e) a miRNA specific for PDE4D7;

(f) a PDE4D7 antisense molecule;

(g) a siRNA specific for PDE4D7;

(h) an aptamer specific for the PDE4D7 expression product or for the PDE4D7 protein;

(i) a small molecule or peptidomimetic capable of specifically binding to the PDE4D7 protein; and (j) an antibody specific for the PDE4D7 protein and/or an antibody variant specific for the PDE4D7 protein.

Item 15: A pharmaceutical composition for the treatment or prevention of malignant, hormone-sensitive prostate cancer comprising at least one element selected from the group of:

(a) a compound directly inhibiting the activity of PDE4D7, preferably an antagonist of PDE4D7 enzymatic activity;

(b) a compound indirectly inhibiting the activity of PDE4D7;

(c) a dominant negative form of the PDE4D7 protein or a biologically active equivalent thereof;

(d) a nucleic acid encoding and expressing a dominant negative form of PDE4D7;

(e) a miRNA specific for PDE4D7;

(f) a PDE4D7 antisense molecule;

(g) a siRNA specific for PDE4D7;

(h) an aptamer specific for the PDE4D7 expression product or for the PDE4D7 protein;
(i) a small molecule or peptidomimetic capable of specifically binding to the PDE4D7 protein; and
(j) an antibody specific for the PDE4D7 protein and/or an antibody variant specific for the PDE4D7 protein;

Item 16: Use of
(a) a compound directly inhibiting the activity of PDE4D7, preferably an antagonist of PDE4D7 enzymatic activity;
(b) a compound indirectly inhibiting the activity of PDE4D7;
(c) a dominant negative form of the PDE4D7 protein or a biologically active equivalent thereof;
(d) a nucleic acid encoding and expressing a dominant negative form of PDE4D7;
(e) a miRNA specific for PDE4D7;
(f) a PDE4D7 antisense molecule;
(g) a siRNA specific for PDE4D7;
(h) an aptamer specific for the PDE4D7 expression product or for the PDE4D7 protein;
(i) a small molecule or peptidomimetic capable of specifically binding to the PDE4D7 protein; and/or
(j) an antibody specific for the PDE4D7 protein and/or an antibody variant specific for the PDE4D7 protein, for the preparation of a pharmaceutical composition for the treatment or prevention of malignant, hormone-sensitive prostate cancer.

Item 17: Use of an antibody specific for the PDE4D7 protein and/or an antibody variant specific for the PDE4D7 protein for detecting, diagnosing, monitoring or prognosticating cancer or for the treatment of cancer, preferably prostate cancer, more preferably malignant, hormone-sensitive prostate cancer.

Item 18: The phosphodiesterase of item 1, the composition of any one of items 2 to 4, the use of item 5, 11 or 13, the method of any one of item 6 to 11 or 13, the immunoassay of item 12 or 13, the pharmaceutical composition of item 14 or 15, or the use of item 16 or 17, wherein said malignant, hormone-sensitive prostate cancer is a hormone-sensitive stage I-IV prostate cancer, a hormone-sensitive recurrent prostate cancer, or a hormone-sensitive metastatic prostate cancer.

SEQUENCE LISTING (12 sequences)

SEQ ID NO: 1 - DNA, 2407 bp, Homo sapiens
  ref <308>: DATABASE ACCESSION NUMBER: Genbank / AF536976.1
  ref <309>: DATABASE ENTRY DATE: 2003-07-24
  ref <313>: RELEVANT RESIDUES IN SEQ ID NO: (1)..(2407)
agtggatcgtgcagtgagatcttgacattggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatctgcaagatcgagcacctagcaaaagatcacccatgtgcaaccaaccatccatcaacaaagccaccataacagaggaggcgtaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacgtgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgcctttttttttttaagtagaaaaattgtttccaaagtgcattgtcacatgcccaaccacggtcaacctactg

SEQ ID NO: 2 - protein, 748 aa, Homo sapiens
  ref <308>: DATABASE ACCESSION NUMBER: Genbank / AF536976.1
  ref <309>: DATABASE ENTRY DATE: 2003-07-24
  ref <313>: RELEVANT RESIDUES IN SEQ ID NO: (1)..(748)
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 3 - DNA, 20 bp, Artificial Sequence
  Primer Sequence
tgcctctgaggaaacactac

SEQ ID NO: 4 - DNA, 22 bp, Artificial Sequence
  Primer Sequence
gctgaatattgcgacatgaaag

SEQ ID NO: 5 - DNA, 29 bp, Artificial Sequence
  Probe sequence
ccagtaatgaagaggaagaccctttccgc

SEQ ID NO: 6 - DNA, 1020873 bp, Homo sapiens
  ref <308>: DATABASE ACCESSION NUMBER: Ensemble / ENSG00000113448.8
  ref <309>: DATABASE ENTRY DATE: 2009-03-01
  ref <313>: RELEVANT RESIDUES IN SEQ ID NO: (1)..(1020873)
tatctttcctatgtttagatatacttagatacacaaatatttcccattgtgttataattgcctacagtatttattacagtaacaatgtaccatctaggtttgtttaaatacactgtgatgttcacacaaggaaatttcctaatgatgcatttctcagaatggatcattatcaagtgatgcataactgtatgtgtgtgtgtgtatatatatatatatatatatatatatatgacacatgcatatgtcaatgtatatatttaatgatgtttgcaattcatttcatagaagttataaaaacattttgatttatccttgattttatagaattcacacacaaagctaataaattctaagattactgaagatgttagttaactgttttaaccaagccacacctggtgaacaaatttgctattttaaaaataaatttagattttagttaatcaaatattgttcagttaatgtcactgttttctagatagcatttttcatgtatacattttacttaatttctttcccaggaaagtattaagccattatgtaatgataaacagtgtgatttttgttgattatatgtactttcttgaattattacctcaggcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtgggtgagtgccctcagatgtcatttccccattttatattttagatggtgattgttgtctgtggtcttttgagtttttgtggctcattgcttgatttgagtgggagaacaatggggtttctagagtcaaaaaaaaaaggatgaatttctcaggtgacatttctatatctgcaggagaagacattttagtgaaattgttttacatggaagagctgaaaatgtattggtgaatgctaataaacatttgccaaagggcagttgtacttggaaaattaatattggccatatgtgacttgatagaagacattttaacaaatgagaactaatggacaaattaccatgtagtgatacatgtctagaaacaataggaaatgttcactgatgcaaaatgaatttggaatcaagaataaattgtattgtaattagaatcaaaagaaatatgcaatggtattcatgagtctaaaaattttgcctttgacattttgaggtattgcttaccagaatactatttcagctcccagtataaggtgattttatttagcattagtacttatagaggagtcagccacagccacgtctccatcatgtaacatttttatttcctactttgcagggtataatttttgtttttattctttttcgtgttgtttaccaatggagttttacactttaaagcaatgtcaccagtttaaaaattgtgaaagaaagtaaggatattgggcacatcaattatttgttcttgtgaccagctgcatttttaagaagcctggatagaaaggaaagaggatgaagccagtgggccatacatagatagactcttgaacatttgctaaaactacaagaacaaaacaattactatgctacaaatgtgatggtcccacattctctgccaagttaaaggcatctctggggaaaatgtcttttggatcttgttaaagttaggaaggttgtgctcagaggaaatttggctagtaactcaactcaaagatactgaatttagctgttttacttgttattgaccagtctaagggacctgtgttagaaaaaggtatgaggaaaatactactagataaataataagaaaacaaatattcaccttgaagcaatgaaaagaggaaatatattttgtttctgttgttgtaattgaactatgtgtttaaagaagaatgcacacacattgatcagactcatactaaagcagatgggaattttatatgacagcttgacctgaacattttttgaaaaatgctgttcccctgaaactatttctcctttctttggaaataacattgctgccgttcattctgtgtagaagagattcacagatatcaggtgtatccagggatcccaagatcaccctcgggttcaatgatttgctagcagagctctcataattcagcaaatagtcatattcatggctctgatgtgttatagcaaaaggattcaatgcaaaataagcaaagggaaaggtagatggaacaaaatctggaggaaaccaaacataagcttccaagagtccccaagtgaagtaagacaagatacacttaattcctccagtaatgagttgagacaacacttgtgaaatgtgttcaccagggatgcctttaccagggaagcctattaaagactcagtacctagagtttttactggaggccagtcacttaggtaccctctgcctaggatatacaaacttccagatttccagaaggaaagtggatatgcagcataaaccacattatttgcacagacagtttaggcaaattgagccagtcttaccatttagagaatggtggatcactcctgaaagtcaggtctgctaaaggccaatgtttcaaacaggtcttcctatatttaattgacacagtcctgattaactgtttactacacaccaggttatcttagaatagttatcttactttcttcacacttgtggaagaagagattataattaaaattaaaatgcactaatttaaagccctgatatattcaattagctttggtatctcaaaaattttggttgctaaccatgatttctcattttgagttggtgttatatcatgtgcccttaaaataaaatgatgcaatatacctaatatatctctatgtagttggatattgtgtgtaatctaaaatcttgagctgggcgcagtggctcatgcctgtaatcccagcactttgggaggccgaggcagggattgattgacctcatgaatttgaggcaagcctgggcaacatggcaagaccttgtctctatcaaaaacacaaataaataactgggtgtagtggcatgcgcctgtggtcccagctactcagcaggctgatgcaggaggatcgcttcagcctgcttgaaggcagaggttgcagtgagtcaagatcctgccactgcaccctggcctgggtgtcagagagagaatgtattgctaaaaacagtttccaagtgccaaggaacttcagggttccgaattgtctatgtcccagcatttctgttgattcacattcatttccatcttcattaagatttaagaatcaagtacaattgacccttgaacaatacaggtttgaactgcacaggttcctttatatgaggattcttttcaaccaaacacaaatggaaaatatagtattcctgggatgtgaaactcatgtatacagatgggctgacttttcatatatgtgggttccacagggccaattgcaagaattgagtatgcatgaattttggtacatgtggtagacccgaaaccaatcccctacatataccaaggaatgactatgtaagcaatgtcatgcttactatttacaaatttatccaatattatgaagaaaataatttttctttttgaaagatggaacaagggtttcatttcaaaagaaacaatagacaataatggccaatcaacaagaaccaaactaagtagatattaaaggtattgttattacatttggaagccagaacaatttgcgaattgaatattgaggactagaaaattcaggagtataactttctggaatgtcgaagctttggaggagaagtagaaggtaaagtgcggggccaggtgcagtggctcacgcctgtaatcccagcactttgggaggctgaggcgggcagatcacaaggtgaggagatcaagaccatcctggctaacacggtgaaacccagtctgtacgaaaaatacaaaaaaaaattagccgggcttggcagtgtgtgcctgcagtcccagctactcaggaggctgaggcaagaggatggcgtgaacccgggaggcagaggttgcagtgagccgagattacgccactgcactccagcctgggcgacagagtgagactctgtctcaaaataaaaaacaaaaaacaaaaaacaaaaaacgaaaggtgaagttcgggcttatattctgtagccattttagttaaccaggagccccagattcctttacagctgtcagaaagagctaatgggaaatttagcctattttaactgagttgtctccagcccattgcctcattattaaaggttagtatgcctttaagtcccattgccaacctatactgagaccataccttagcaattgcaaatctttgatggtcaaggcgacttttcatgccctccagatttattttcctttctttcttaacatcatagccttttgctctttcttctggcatatcagtatgccagatactttctttgtcaagtgtcaggcagtgggtctagagacttgtaccacccctttagaaagccacagtatggccctgagaatcattagtttctgaaaaagaactttgatgtgcagaaataagtgtcgtagatgacagctattagcttcctcatgaagtacttgggtcaagagactgagttcaaaaggacttttagttattcacacttccatatttctactttgactttttttcccaagcaatgcgaatgtgttcaaatgtacactttttaacaatttcttttgagtatgcccaaactgttaggttgtgtgtatgctgtgatttagcaaacttaagaaactgtaaatgaacagaaaacagaattattaagacctgggatgcctataaccctgaattcatctgccagttaactttctgtacagggtaggcgaattcaggcttcatggctgtttactgaccttcctcgaagtaagagagacagctattaatgacttgaaatgttatgaacgtggcatagaagtaatttggaaagtcagtttttcatattttcctcctaaataattttctattacctttcataaaatctttttattaaggtataatttacatgcattatacatcttgaattaatatgtatttatactgtcatgtaatcaccatcctatttctcaactgatcactaaaggttattttgcctcctcttggacttcacataaatggaattgtactgtatgtacttgttgtgtctggcttctattagtcaaaatttttttttgatatccatgtttgtgtatatctcagcagcttgtttttattgcataaatatagcataatgtatttatttttactctcttactaatgaacctttgggttgtttctagtttgaggggattatgaatgaagctgctatgtacacttataccagtctttttgtgaatatatgcactcatttcttttgggtatattcccaggagtagcatttctgagtcataaggaggcaaatatttattttcattactgcccaacagttttctaaagtgttgtactcttttaccctcccaccagcaatacgtagtaggtacagttgttctacattctcaccaacacttagtattttcagtctttttcattttggtcattctggtgaatgtgtagtggtatactactgtggttttaatttacatttccccgatgagtaggaatattgcttaccttttgatgtgtttattgaacatttggatatcttctttgtgttatgaccattcagacatttgttcagtttttattttacttattgatttctgagggctctttgtatattctagacatgagtattttgttagacatgtgtattataaagtgaatattttgttctaaacagtgtcttgaatttttactttatgtttactttgaatatgttggtaatcctagggacctgtgaaatatgagggaagtgtgcagcagggagaggaaactgtaaggcaagaagtggacccaccttaataaggggaaaacaagaatgacatttaacctgcagagcaatttcacttggagacaaggacagctggtcccttgaatattggatggtggcaaataagacatccaagcactaagagggcaggcagagaagagttgagaatgaagcaacagcatgcttatggtggctgatggccgggtagtgagtagacaagagtggggctctggacatagatggtctgaatttgagtcctgtctcccacctactaccatcttgtgaaggtacttaaccactccaagttcctaattttaaaaaagcaaaagtaggaataatgcgagcacctacttcatgggtttgttctaatggtatactacctatccccatttttcacatattgtgaatacttaatatataacatcaaaaactgcaactcctatgctgggaaaatattagaacaaataatgtttgttgttgttaatatttgtttacttattggaattggcttcagagatactctacaaataactcttggggtagagatggatgttctagcagatttgggagtcaatcagaaattggctcctgtttcagaaagttacagttattatggacttgtgacatttctgttcagaagtctgtatctggcatcttcccgcacacatgtcttgctttcaagtgctgttcagttatgtttggaatgagaatggtggtctccctacttctgcttcacttcttccacaaccttgctgacttctaaatagtttcctgcttagaatccttaggaggaattaggatctcctttcagccctatcttgggcactgacttacattcccacatgtggtccatgtgcccctagacaatctaaggagagtctagcttgccacacatgtggaaatcattcccagttcacaggtgggaagttatgggaatgaagaaaatgtgggggaggtagcaataaaactctctacttacatttcattgctgcatctgctataataaaatgagagccaagagcaacttattcccttgtgacatgatgacacacctctggatagatgtatattcagggatatgggtgggtggagaatgttacaaacactttctcatccctagtatcctattacctgtctgaagaagtacactgtgtaccttcgtatcactatgtcctataaaaaaagaaaatgaaaagaatgtaaaagaagacatggtcacttttggggataaatttaactacccaacagagagagaagaattactttattcatataagggttcattttacaaggatcttccagaaatatttccttgatttgtgtgctattcacagagggactggtcacagatgccagttagacattggattctttgactaaccactcttcatcttgtgctcttgagtacaaacagtacgttagagagaacattaaaaaaaagattgttttcagcaatttattcctgaatcaaaatccaaacagaaaataaaaaaggaaaaacagaaggctggatcagacacatctgatctttcaaatttggccttttaaacttaagaaggtattaatgggcatttcatattttaaataatttggatataagggtgtttataaagctagagattgtatttcacagtctaccatgaagcctgtaccttcatgtttgatgtatgttcaagctttaagtgatttatctaagttcttattgaatgttatatggaagatctataacccactaggcaaagcttcccaaaattgaaaataaaacacataatcatgattgtgaaacattctgtagaaatatagtattcttgagctagatgaaattttaaaagtaatcaatgccaaaaattgggaaacaatacttccaataatcttgaagatgcatactaagcagacaaaattggattcttttggttttgattgatttacatgcaatttatgattgtagtgtttatctaaacttctcaggatactcacaaaatatcacaagccttttattttaaagcattgttctgatttaatcttatctgtctttgccttaaactttgtaaatttgtgattatttttgttttgttttgttttgttttgtttttgaaacggagtcttgctgtgtcacccaggctggagtgaaatggcgtgatctcggctcactgcaacctccgccccccaggttcaagcgattctcctgcctcagcctcccaagtagctgagacgacaggcatgtcccaccacaccaggctaatttttgtatttttagtagaaatggggttttgccatgttggccaggctgttctcaaactcctggccttatgaaatcttcctgcctcagcctcccaaagtgctgggactacaggcgtgagccatcatgcctggccccaaatttgtgattttcaagattaaaattagattctaagagtgatggagcactttaaaatatctggataaaaatcatcttatttccagaatcagggcaattcttgaatctaatctaaaataagcaatgtaaaaatgctgacttttttctcacctatcatagactctctaaaaggtttatgctatatctgccatgccttcaatttacaaaataatatgatcatgattaaactccagtgtctttttcaggttatcacagtaccttttcattattgtagtacattctggtgtccccattaaggatatgctgaatggactgatactataccacagtattttactttatatctgtgtgtcagtaaagcagcatgtaccaggggaaggtttacctttagaaatcaaaggcttctatttcaccaggctcccacgttgttaaaaacactaaagagggtgacaacttctgcgttcaccaacatcagagcatctagtccctattttcaaaactttcttgtgccaatatgacttgttttagtaatagagattggttggggaatcccatattttttaaggcaaacccaaggaagcatttattttaccgtgaaaagtgctagggcacaatactatattaagcacaaggcagaactcaacaaagccctttcctttgattatttccatcactcaataataattgttccactccatagatagtttctttgcaacaaacactgccctggctgaccatccttctgtaatgcagaactgtgaatcactgaagtgtttaaggagagcttataattctttaaaagcctttttattctgttttacagtatttgtgtttatgaaaaaaatgcaggtaaaaatattctgaccaaattgtatttgtttaattattatgtattgcataatgtataatactgattcaaacttaacatgaccagagtgcattgcttggagaaatccaaaatgaaaaatatattttcagttgaaattcattaaaggatgaagtaatcaaactttttttctctacaaatgagcactacaaaatggcaaaagttttcttttaaaaaatctgtatatagaaaaaaactatagaaaaaatatatcacttcttgggttaaacacacttccccccaaccaaaaaaaaattctaggtacttagaattctttctagaacttagaatttccatattatttttcatcccatttctctcattcatttagaatctgccctccagttgaaaggaagtagatggagccgggcacttttagattatttcaaatctgaggaattcaacaaaaataaatgctatttagttatgttgtttgaagtcatgtatgcaacatatctggatgatgggtcaactttgtttaatagattagcatcatttacactgaagttcgtggctctgagcttcgttaaagtgagacctttgtccacattcccaggagggctttttctcagggggttctgaattttaccatgacgtaattcctaaacagttgtgattagtgctaaatgttatcataaacacacacacacacacacacaccccttgctgtgtgaaagctagatatagatattaaaaactttagaatacttgttttttaaatatgtaatttataatatataaataatatttagaatataaagtttataatacataaatactatacttctttaccattcactttctagaactttcccagcttttgatcacatatttcaagggtggtctccctctttactcctctactaactcttctgtgtctcagttaacatgtgattttggctttcttatttctccaacattatttaattcagactaactttatttcttgaaggtatataccagacatacctcggagatattgtgggttcagatccaggccactgcaataaagcaaatatcacaataaagcaagtcacacatactttttggctttccagtgcatataaaacttatgtttacactatattgtagtgtgtaatagcattgtctctaagaaaacaatgtacatgccttaagtaagaaatacttaattgctaaaaaaaaaaatgctaacaaccattagagccttcagcaagtcagaaacattttgctggtggagagtcttgcctcaatgttcatgactgctgactgatcaaggtggtggttgctgaagattggggtggctgtgacaatttcttagaataacactacagtgaaaattgccacatccattgattcctcctttcatgaacaatttctctgtagcatgcaatggtgtttgacagcattttacccatagtagaacttctttcaaaattggagtcaatcctcttaaacgctgctgctggtttatctactaagtttatataatattttaaatcctttgttgccatttcaacaatgttcacagcatctttaccagaagtagattctgtctcaagaaaccattttctttgcttcatccaagaaacaactcctcattctttcaagttttatcataagattgcagtaatttcattacaacttcaggttccatttctaattctagttctcttgcaatttccagcacatctgcagttactttctccacttgaacccctcagagtcatccatgagggttggaatcaatttcttccaaactcttgttaatgttgatattttgacctatgcctatggatcacaaatattcttaatggcatctagaatggtgaatcctgtccagaaagttttcgacttactttgccctgatccatcagagaaataagtgtctatcatagcgatagccctatgaaatgtatttcttaaataataaggcttaaaagttgaaatgactccttggaacatgggcttcagaatgaatgttgtggtagcaggcatgataacattaacctccttgtgcatctccagcaaagctcttgagtgactaggtgcattgtcaatgaacagtcatattttgaaaagaatctttttttctgagcagtatgtctcaacagtgggctcaaaatatttagtaaaccatgctgtaaacagatacactgtcatccagtccttatttttttatttataaagcacaggcaaagtagatttagcacaattctcaaaggccctagaattattggaatattaaatgaacattgtcttcaacttaaagttaccatctgcattagctcctaccaggagagtcagattttcctttgaagctttgaagccaggcattgacttttcctctctagctatgaaagttgtagatggtatcttctcccaatagaaggctattttgtctccactgaaaatctgttgtttagtgtagtgccttcatcattgatcttagttagactttctggataacttgtcacagtttatacatcagcacttgctgcttcacttcacactcctttttttttccagcttttattttaggttcagagggtatttatgcagctttgttaaatgggtagcttgtgcaccctgtacttttatgtattggagatggcttcttttctttaaacatcatgaaccaccctctgctggcatccaacttttcgtctgcagtccttaactctctcagacttcattgaattaaagagagttagggccttgtttgggattaggctttggcttaagggaatgttgcggctggtttgatcttctatccagaccactgaagttttctccacattatcaataaggctgtttggctttcttgtcatttctgtgttcaccagagtagtacttttaatttccttcaaaagctttttctttgtattcacaacttggctaactggtacaaaaggcctggctttcagcctgtcttggcttttgacatgtcttcctcactaagccttattatgtctagcttttgacttaatgcgagagacctgtaactcttcctttcacttgaacacttataggccattgtaaggttattaattggcctaatttcaatattattgtgtgtcagggaatagggagacctgaggaaaagagagaaattggggaatggccagtcagtgaagcagtgagaatacatgcaacattaatccattaagtttactgtcttacatgggcatggtttgtggcaccccaaaaattaaaatagtaacatccaagaccactgatcacagatcaccctagcagatataataataatgaaaaagttcataatattctgagaataccaaaatatgacatagaaacacaaagtgagtacatgttattggaaaaaatggtgccaatagacttgcttgatgcagcattgccacaatattcaattggtaaaagcacaatattgtgaagtgtgataaagcaatgtgttagtctgttttgcatggctataaaggaatacgtgtgactggctaatttacaaagaaaagagatttatttggctcattgtttagcagggtgtctgggcaaggcaccagcatctgcttggcttttgtgaggcttcaggaagcttttattcatggcagaaggtgaagggggagcagctttgtcagatgacaagagagggaataagagagggggcaggtgccatattctttaaacaattagatctcacaataactcatgaccacagggagggcaccaagccatttatgagggctctgaccccatgacccaagcatctcccactaggcccaccatcaacattgggaatcaaatctcaacatgagatttggagggtataaatacccaaaccatatcaagcaaagcacaataaaacaagtatgcctgtatttatacacatattacaaaacagaattaaaaacaataaaatcatacatgcaagggattctggtaaatatactgatcccctcaatcatgcattagtcatatattaatgtattcactttatattcaaccaacaaatagtgagagtctgatatttgctgtatactgaggtatgcactggcgacccaaggctcaacaagacaaaacacagccttttctttcacaggggattgaatcaagtagggcacgtgcaagaaaatagaccactataatcttgtttgtttcatataatgtacaaatatgactgcagacaaatggagaaatatgaaatctcactggggagcaaactcactttggcttgtgaggaactaacacctaacctgagaccaaaataagatggttccaggaagagagaacagcaggtcaaagtccagggatgagattaaagtagagtgtctgcacttagctaaataaaaactgctaaaacatggctagaccagaatgccaattgaaggtacagttgataaaacttaccattaacttttcatgtaaccaatatgtgaggttttgtaatattttccagtatgctaagcagctatgatataaacactgaaaaggcaaacagttggattattccaaaattggaaagcaggtgcaatataagaaaaatagggcaagggatttgaaggtatttgaaagaaagtgatagaaatgatgaattgtggcaacttagctggttatggaaatgagtgaatataagaagatactgatatagaaagtattcaaggtctctagaaatctctatgatgtcaaacaggtgaattagaataactgagcaaacaaaagatagatcatatttggaggacagaatgaactttaagatgtaagtgctagaggtaatttaaggtatgttcaagacatagaagggtgtcagggaagagggtgactgccttggaaaagatgtagctgaggaactgagagatcggggcatgaggtgatgcctccacatcaacatcaaagtcacccaggactgcagcaggattcaagctgtcaagatgacaaaaaggtgggcagttttcagtgaatgagaaactgaccaaagggactggcagaagtcagagacaaggaagtagagttgattggcatagatgtcaaacgagaagtttttacaagaaggtggaggagtaagtaaaagtgagtaaccaggagagcacccatttcatcttgggacccagagagggcattgagaaccagagtaccttaccctgaatccaccacagggaagtgacatctttagcgaagagtcaaatttgagagaggttaggatctgggatgactttttggtggcaaggctgaggatgaagtgaagtctgtttgccatgggaaaagggatccagagaaactgattgaataatatggaaagaatgagaatgggaggatagacaggggagagaaatcacagtgcaacatggggataagaagttgaaagaacacagggagaggaagaagctctgtatcaggtggttgtctgagatatgattatgaaacagcattccaaaatattttcaataattggtccacctgtcctctgactgatgggtgttaaaccagggaacaagaagttgagcatagctagtaggtcttttggaaagaccataacgtttgtcctagtcccagtaagtaggtctgcaatggtgtccttgggttcctagtacatttcagcatctattggagaataggagcttctggtgtttcagtacttctgcatcttccagattactcagctgtttcccagatttattacagtctctggagtatggagaaggatctgattttttaaaaaatatgaattatcattttcaaagtattagtttattttaaataatttttatatctaactctaatattttgccagcaataataacatcttaggtattttgaattagcatttgagtttgcttttgagaattttagttcttagaaataataattgaattaaacactattgctttcttatatattcttaaatactatttctggcattcaagcattattccagttcgtcatgctgccaattttagcaataaaataaagaataaaattgaattcaatgtggaaaaattctatttgtagaaaacattcgtctgtaaacggggttactgttgtgaccttagtgaaacaacagaaaggcacgtgcatacggttttgcccttagcttggatgtaacatattatttgcagactttaagtcatagcaacctatgatcatgctaatttttatttaaggctatttgatagagttgtatgattgagacctggaaccaagatccttgatgtaatacatatgtgcacacaatttttttattctcttctctttggtgaccttgtctgggtcatttttttgtttgtttgtttaatttacactgtttgaaacagtatctgtgactagaatttggcaactgtagagtatatcatatgtacacagtgccttagcaaagggttttaattaaactcagtggaggagacccaagcagaggagccttcatttgtcttaagaagaaatgtcaaggttaattgattttcagaggattatctgcaacaaataaagaccaagactcatatcttcttattttggcttataaattctggtatgttctgttcaatatccactgaaaaaaactgagatgagagtgtttctataaaactctatatgtcaaagcatcctttgcagttggcaaaactgaatgaatgacagtgaaaatgtatacttatggattatgatatagtcattaaaatgattattatgataagtatatggtaacatggaagtatttagaatgttttgaggagaaaagcaaaatatacaagtatatccaggttaaagttaaaacactgcaaaatatatgcctgcatgtggctgagaactggaaaacaatgtgaaaataatttgaattttttgatttacaaaattgtggttttttatttttctcacattgatttctattaatgaaaataagtgtttatccaatcaataaaattacattaaaatttattatttatttacaatttcattcatacaaattcatctattgtgtcttagtatatgacagacacagtttgaggtactgggaatattttatatgtagattttaaaaattcatgaacttttgtttttcacaggcaatccaataggaagttttggcaactatggtgggaggtagggatacttgggcctttcagaattctccagatcactttgtataaccattcctctgttggtgaccgactccccaaaaaagatcaccagcagaaccaagtgaaactaagtattcatctcagtgaaataagggaggacatcacctttaaaattagtagtattttggaaaggggaagtaaagggaagatatttgtagagttttatagccaggtctgggagcctgatcttgcaaggtggaaaaatggctggcattaggcagaatttagagcctagcagttctggattagtggggtctctaagagcagtgaggttctcaaagtgaaccttgataagtgaactgttagtcttattgaataagctggttcaggccatttacagccttattttccaaaagcaaacatttcctggagcaagtacctaagttatttttgcttggtctccatgtgctcagcattaaaacaggcatttaaactttgactccaaattgtttagcactgggacagaaaagtattttggtttcagtttttaccttctttgtgagcgacctaggtttgatcaactcatttggctgacaagccggatcctttgtcccttattttatttttttagacttatattattgtcacctatattgcttggaaatttaggaaacacagtccttgggatagctggggggatgagaagtcaagagaggtaaggtcttagggtagacaactgggtagatactgggctactcagtatccaatcctcttctgttttgggggagtttcagaataggtgagagaaaggacctagccttccactaggggagtaggaatatgcattccctctgcatgcccctctggcagacagagggagggtctataacctcaatgtagtcaatctgatgttcctagccaggactttgaatcttgaggggatggctcagaccatcacatatgccactatcgagtggaagggccagtggcatctgttgtagctgctgacagtgtggcgaagagcagtgtgtgcccagcaggtgaggaatagggtcccaggcagactgatccagcctcccagctgcttattatcttcactggattctgctcaagtctgcttcttcaagctccctgtttattctgagttctatcctatattcttttgatggattccttttcctgcttatgtcaatccatcatttctattgtttgcaaatcacagcccttgatcactctagaaactaaagtacagaaagtgccctgactttgctagaagtttaggtgtaaaattagtagtaaagttagtaaggaaaaaccaaaggggaagattgaattttattttaatgcattatttttttacataaaaagataacaaaaggagggtagtgaagagaagagtctcttgagatgtccgtggcaaagtttttaaagctctcaataaggagacaaggactgggcttcattgcaattattcccttttgactgttgaagctggtaggcttacaatggactcctaatgagagtggtttgcactacaattaattaagtgcatgacattataaactgcatgtctcttccctctggagaatattcttcctatataagtgctattttgttttaatttctctctctgtctcttcctctctgtttccctctctttgtctctctctcttttttatttatttatttattttttattattatactttaagttttagggtacatgtgtacattgtgcaggttagttacgtatgtatacatgtgccatgctggtgcgctgcacccactaactcgtcatctagcattaggtatatctcccaaagctatccctcccccctccccccaccccacaacagtccccagagtgtgatgttccccttcctgtgtccatgtgatctcattgttcaattcccacctataagtgagaatatgcggtgtttggttttttgttcttgcgatagtttactgagaatgatgatttccaatttcatccatgtccctacaaaggacatgacctcatcattttttatggccacatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgcttcctgactttttaatgatcaccattctaactggtgtgagatggtatctcattgtggttttgatttgcatttctctgatggccagtgatggtgagcattttttcatgtgttttttggctgcacaaatgtcttcttttgagaagtgtctgttcatgtccttcaccactttttgatggggttgtttgtttttttcttgtaaatttgtttaagttcattgtagattctggatattagccctttgtcagatgagtaggttgcgaaaattttctcccattttgtaggttgcctgttcactctgatgatagtttcttttgctgtacagaagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacgtttaagtctttaatcaaaagttgtccctgaaggaaaattaactctgctgttagtccactgagaaagcttctcttttaatactggaacatatctttgtctaactctccctcacacctagtgctaaatttatcagcgttgttcctgatacaaacattttgaagacaatcgtgaggaaaaagatgaaaaaagttgcatttaacttttgttacaggtgtccttgttctccagaagttactgtctttgttgtagtgtgcatgcagtcacaggagtgtgcatacatgtgtgaagtacttgagaagtgtatttgtccgttctcacactgctataaagaactgccctagacggggtaatttacaaaagaaagaggtttaattgactcacagttcagcatggctggggaggcctcaggaaacttacaatcatggcagaaggggaagcaaacccttcttcacgtggtggcagcaaggagaactgcagagcaaagtggggaaaagcctctataaaaccatcagctctcatgagaactcactatcacgagaacagtatggaggtaactgtccccatggttcaattaccttctaccaggtctctcctgtgacacatggggattatgagaactacaattcaaaagatgagatatgggtggggacacagccaaaccatgtcaagaagtatttcagagacaagtcattccccaaaccttatcatcagggtcaagacctggcaggtgagacattagcaggtgaacacaacattctcagaaacccttgagagtactcctttccctccaggcatcttctttcaaccttaatatattctattcaattatattcacagctttttacctcaattataattccattcttccaaatttgttttcttctcccatctttcctcctaataaaatatctattcttcagatagtcttcctttgtaaaatagaaaggatctacaaaagccattctttgtgagatgtgaatcatttcaaataaattaatgccttgttctaatgtgaatggtggacttgtgaagagaagtgggtagatatttgaatttctgaatgctttagaatattagttgcacatgcagtaatatttcctgtagcttagaagaaattggttggcttaacagaaaatgcaattaaaatagtttacaaataggttctggcatcaataatagaaatattaaagaaactacatattatatcaagatgcttctctttttttcggggggggggtgccttttcttccttgatgaacacagtactctttcttctttgtcttttatcttccatctcaaattgtcaataataaatttgaagaatggagaataatacattatcacgtgccagaccttatgctaaacactggatatgttatattgtgtttcatactcaggatgatgctacggtaggtaccattattatcttattttacttataagaaaacagaagcctggagaagttaaacaatttcctcagtatcagaaagaaccaagatcaaatatctaggttaaggtattttatcttaacctagatatgccagaatatcaaatctaggtttcactattattttgtattctatccaaatttctaaaactgctaatgatggagggctgttatatggttctagctttatatatttttttatttcaacttttattttagatatatgggtatttgtacagatttgttacatgggattattgcatgatgcttaggtatggtatatcccattaccctgatagtgagcatagtacaagataggtaattttttaatgcatcccaccctccctctaccctctagtagtccatggtgtctattgttcccatatttatacatatgtccacgtgtgctgaatgcttagctctcacttataagtgagaatgtgcaatatttggttttccattcctgtgttaatttgcttaagaatatggcacccagtgggccgggcgcagtggctcacacctgtaatcccagcactttgggaggtcgagacaggtggatcacctgaggtcaggagttctaaaccagcctgaccaacatggagaaaccccgtctctactaaaactacaaaattagccaggcgtggtggcgcatgcctgtaatcccagctactcgggaggctaaagtaggagaattgcttgaacccaggaggtggaggttgtggtgagctgagatcgggtcattgcactccagcctgggcaataagagtgaaactcactctcaaaaaaaaaaaaaaaaaaaaaaaaaagcatatggctcccagctccattcatgttgctgcaaaagacatgattttattctgttttggggttgcatagtattctatagtatatatgtaccacattttctttatgcaatctactattgatgggcacctgggttgattccacatctttgctattgtgaatagtgcagtgatgagcatatgagtgcatgtgtctttttagtagaattatttatttttgtggaagtatatacctggtaatgggattgctgggtcaaatggtaattctgttttaagttctttgagaaatctccagactgctttccaaaataactggactaatttacattcccaccaatggtgtataagcattcccttttcagcctcgccagtatctgtcattttttgacttttttataatagccatcctgactggtgtgagatggtatcttattgtggttttgatttgcatttctctgatgattagtgacgtaagcatttttcatatatttcttggccacttgtatgtcttctgttcatgaagccctttgcccactttttaatggggttatgtgttttttgcttattgatttgtttaagttccctgtagatagtgaaaattaggccattgtcatatgcatagtttgcaaatatattcttccattttgcaggtcttctgtttactctgttagtttctttgctgtgcagaagctatctagttggccatcttggcatctaatctttaattttctttctaaaatatttgaatgttttgcaatttctgactgaagttacttccctctttctgaagaaggccctgctgacatcaataattatctgagagtgacataagctgactccgattatgccaaagtaacccttacgtggtatgaaaagaaaatgaaggtgactatgattcctggggcatttgagattctgagaaaactccaggtcagctcgccataaaaattccccacacctgtagtttaatttaccaattaggaaattatatatttggggctaaatggtttctgatttgttggcctgaaagaaataatgtacttttaacaactataaaagttctctgctaggaatatcttaaatacagtgaaaatctgccttgacagtggacagtaagttagatttcattgttgtaaattggcaccattaactaaaacccttgtccattcaaaataatatgtattgtcacataacactaagctctgttattaaactgccacagattattgctttaacagtttgaaaatgatttttagaaaattgactttgtacaatgctatattagagtctgttaattgatgagaaaaccaaactcagatgacatttgcaaaaataaaattggcatcagttgaaacatctgtaccatttctcttatttaaaagacatttttcatctggaaaatgactacttcgattagcctcagatcacaaccacaaaataaagttgtctatgggtggcttcttatttgcatttaaattattatgttgcagcattttgtatgcacaagcaaatggaagattgttttgaatgacataggcctatacacctgagagagaaatatgtcatctacaaaatgtaaaaatataggtttttgtaaatgcctctgaaaggattataagaatctacattttcccctccctcctggagtttgtctttctattaaggctctagacgaagaaaagctctaatatactttccttggaggggtcatgagacaatgaagcataataggatttgaagtatattggatataaaattcatgtgatatcctcaagtagagagatgttattttactgttctttaatctttactgttggcgataattgcctttgtaaactaactttatgttgtaaactagtagcgaaccagagattgagttgagaggtgggggtaacagatgagatcctcacttgtgagggctccaagggcctgtgaggcaatggaaagggctgaccttgctacctggatgggaacaatgctgttatcattttcatgtgctcctgtttagaagatgagttaacatccataaaaacaagttagactaagggttgtcacactacagcctgtgggccaaatgctgcctgccacttgttttataaatgaaggtttcttggagcttgcactactactgcagagtagagtagtggagatggagaccattcggcctgcagagtcaacaatgtttaatatctggtgctttacagaaaaactttgccaagccttgatttagacttagtaactttagtaagaagttactgactgcacaaattaccaggatatttaagcttgtaaagtattaaaataccataactatctgcttcttgtggcagggagggggccaaggagaggtgaagtggttataatgctcgtgcattggttccttcattcaccagagtgattgtgcgccctctctgaaacagggataatgccaggtactcaagatacagcagtgagcaaaaagaggcatagtgccttccttaatggagatatgcattggagtcacatagcatataatgttgacaaatatccctgctctcatggatcaagaggttagagttttagggtaaccatggaagatctcactgagaatgtaactttgaataaaggattagaggacttgaggaagccaaccatgctgctagagtttctctgcagaggaaaggggagtgatgagatataggtgaaggacaatgtgagccaagattgttttttttaagttgaggaattaacagcatggttgtatgctgagggggacaattcagtggagagggaaaaattgatgttgcaggaaattgctgggataatgtctttgagcagataaaaagggattgatccagtgtacaacagaagggactagtcttggttttggatcaaggacagtttatccatagtaaaataagagaacgtagagtatatgggcacagatgcaggtcattgggtagtcgtggtggttgaaaattgtagaagttctttttttaaaactttaatttttcttagtatgtgcaaaggccttgaagcaaaatagagcatggtataatcaaagaattgagagaagaaaaacataatctaactgtaaattaagcaataccatggagccagatgaggctgacgaggtacacaggatacagacgtcagcaagactaagaatatggtaatgctaaaccaattaagaatggggttaaatcaaatttgcctttttaaaaaaagatgactgtggctactgatagagattggataggagagtgcaacaagagtttctgtggagagaccaatcaggaagctactgcagtaattcaggtgggaaatgaaggcatcatggtctagagtagagggagtggggagaagagaaatgatcagattttgagagatatttagaggcagagtagatagacttacctcacttatgtttgggtatagaagacattgcctatgtaaagactgagtagagaagagagcctaggagtagatgtggacactcaggagaaggattgagatcctggtttagaacactgagtgaagaagctgggtattgttaaagaagagagccaaacttcacaactgcctagcagtgaagaagcagatcaacaaaaatcatatggtgcggaagggatacttgccattagattagtccagctgaagccaaacgctggttgcttctgatttttttaaatcctataaatatattggttaattttatttaaaaaaattgaacttttcattctcataatgagaccaaagtaaaggtcaaaatcttaagaagagaatgggtcagaacatagcaggcagattgttgtttgacatgatgtcaatggacacttcagttgtcatgttctaggcccattacattggcctttcctcttttgaagcttctctcatggaaccaagtgcattttatatctgcatctgttccaaatatgggtataacacagactctgtgagtagcctgcaatgtgtttcccttccacatattgctagataactctgcttataaaaatctgcttgcaaaaatcatagaacttgcagatcctgtcaaaagaattactattagatgaagttaagaaatgactgtagaagtaaaagaacaagagctggtcttaggagttccatcccttcatcagtctaggagggttgggatcttagaggcatttttgagctgaaaactcaaggcaggaaacaagccatcccactctgaatagggctgtgtttctcacctgaacagtgagaagagggtgttatattttctaataaaatcccacattaagttagacaaaaactctgtataactatggaatagactttactaatggaaagagtaatgtgaaaagctaaataggaaaattttaggcacgtattttcacaatagatcttgctgtacttgggggaggcttgtcttcttgattactaaggttaacttagtgcttcagaagccagcccgtttttatgttctgctgttttcctgattttggtgtgtcttgatgccactgtgttctagtaaaaattcccttcaatagactgccaggagagcagaccagggagtgtgagtgttttgtgcatgggcgagcacatacagatgttaggtgacagtggttattcagtcatgctttcagacctggagaacagttcaggtcaaaatctccaagtctgtggaatgaagctttgggggaattaatcaaaatgttactgaaagaaaagggaaatcaaatctgacttccacccctctgagatttttgttgaggacacagaatgagagcataaccttcaggtccagagtggaatatagagagatcttccactgacaatatgctatcaacaaaagcaaggtagagaggaaacgttgagcctcagcaacctgtaagtcaagaccctctccatcatccctagatgcttttgctctgtcattgggattgtgtccctttctataacactgtgacttctttggatctccacagcctgactgtgttcacgttctcctctccagtcttttagtttctcttacagagctggtgcatttctgtggggacagagcagctggaacctgggcccgaagctggttcagatatggaattccctttaagagcaaaaataacaattactaatataatacaagcccaatacaaagtgaatagttaaaaggagaaaagatatcactatgaattcaaattttaagttaacatatatcccaactaccacaaaatattataaatcataacattttattaactgcccaacccaattttataatacattttcccctatgcttggctaaatattctttgattgtctctttaaatgacactgaaattgtaatattttctatgtagagattgggaagatactttaaacttttcttcaggattgttgatttttaaaaaattattaatagttagaaaagttttgtaatgtcatatacattcttaacattgttatcaaattttgagaaatatttaaatttttttttcatgtaggagcgtaagatttcagggcattcgatgtggtgtgtgtgtttgtgggtgtgtatgttgactaatcttacatacttgtattcttttaccagtttgtcatcgaagtgtcactgcatttgtcatgagatttagatcctctctgtcaatgtcaacattttatatcaaatcagaaaaaaattaaaaattgtttcaatgtgtgttagtttgattaactccttttcattaatttacttgtcaagcaacccaagggccaattcatcatatctatttgaaatttatctctttctcttattgaattaccacttttgagatgatctggaaaaaaattgttacaatgtactgtctgatatctgaataatttctattgatttaaccacttggctttactgcattttcttcatactccaataattgtatttgaaattttcttattcatttatatttttagtcctttaatctaaaaaaattaaggataaaaaagcatccttcacgtatattgaaatcaggagtcagtaatttttcacttgtttaaacattcaaaacatctttctaactcacttcttgatattgggataattttaattttacttttgcaaattttgccaaagcatctggctaaataaacacacttgccagggcaccgccccagagcctcggcaggtacttatgcaagcagagagccctgcagctttggcttttatcatcttcaccataaacccatctctgattctcccctttccctacagcactttccactaacaatacacatacacacccatatcacacctatactatttatttttctttatgccccttttctgtagtatttatatccatagcaattatcaccatctaacacactacatattttgcttatttatttatttattgtttatctctccacactagaatttaagctttgtaaaggcagatgtgttcctttcctgaggctgccatataaatgaccacaaatgggtggctcgaaacagcagaaatttattctctctgagttgcagagagaattctgcatctcagaatacagttcaaaatcaaggtgctgtagggctggttccctctggaggctctgggggatgattgcttgcatgcctttcatagccgccagtggctgcttccaacccttggcactccttggcatggggcttcatgaggttcaatctctgcctgtgtcctctcgtggccttttttttttttttaatctgggtctctgtgtcttctctttttctgatcttaaacataatttcttgaggaaatcataaatcattggacttgtagctcaccctaatacatggtgatcttatctcaaaatctttaccttaattacatctgcaaagatcctttttacaagtaagtttacattcttattccgggtgaacttatcttttgtggaccacagttcaactcactacagaagttacaatttttctgttatgctcactgatgtgtctccagcacatagaccagagcctggaatgtagtaagtgctaaataaatatttgttgaaggaatgcattgagagcctatagtgccagatgctgaggtaggtacttagagcactgcaatttaaatattccctaactataatttatcttctcttttcaattcacatataaatatttttttaattttttaaattttttattttagattcaggtggtacatgtgcaggtttgttacatggatatattgcatgatgctgaggttcgagtttctattgatcttgtcactaagataatgaacatagtacccaattggaagtttttcagcccttgcctcctctctccctcccctctttttgagttccttgtgtcactgttcccatcgttatgtatgtgtgtatgcaaattttagcttccacttataagtgaaaacatgcaacatttggtttgctgtttctgcattcattcattcattcattcaatggcttatggctgcatccatgttgcttcaaaggatgtgattttgttttttcttgtggctgtgtagtattccacagtgtatatgtaccatattttctttatccaatccaccgttgatgggcacctaggttgcttccatgtctttgctattgtaaatagtgctgtgataaacatacatacaagtgcaggcatctctttggtaggatggtttattttcctttggtattatacccagtaatgggattgctgggtcaaaatggtaggtctaattttagttcttttggaaatctccaaactgttttccacagggtctgaactaattttcatttctgcaaacagtgtacaaccattcccttttctctaccgtctcgccaacatccgttatttttttacttttcaatatagtagccattctgactggtgtgagatggtatctccttgtggttttgatttgcatttctctgatgattagtgatattgagtatattttcatgtttattggttgcttgtatgtcttcttttgaaaagtgtctgttcatgaccttttcccacattttaatggggttatttggtttttttcttattgatttgtataagtttcttatggattctggatattaggcttttgttgaatgcatagtttgcaaatattttctcccattctgtaggttgtctgtttacttggttgatagtttcttttgctgttcagaagctcttcagtttaattagatcctaattttcaatttttgtttttgtatgcaattgcttttggggacttagtcataaaatctttgcctaggccagtgtccagaagagtattttctaggttttattctaggatttttatagtttgaggtctcccatttaagtctttaatccatcctgagttaagaggtaggggtccagtttcattcttctgcatgtggttagccagttttctcagcactgtttattgaataaggagtcccttcccccctgcttatttttgttgacattgtcaaagatcagatggctgtaggcgtgcagctttattttggggttctctattctgtttcattggtctatgtgtctatttttgtaccagtatcattctgttttggttactgtagttttgcagtataatttgaagtcaggtgatgcctctggctttgttctttttctttaggattgctttggctattctgctctatttttggctccattttacattttagaataggtttttctaattctgtgaaaaataacattgataacttcatagaaatactgttgaatctgtacattgctttgggcagtatggacattttagtgatattagtcattcaaagctatgagcatgaaatgtttttccatttgtttatgttgtctatcatgtgtcatttatttcagtagtgttttgtagttctccttgtagagatctttcaccttcttgatagtcctaggtatttgtgtgtgtgtgtgtgtgcacctgcgtgtgtgtgtgtctattgttaagtgagattgtgttcttgatgtaggtctcagtttgaatgtcactggtatatagaaatgctactgattttcgtacattcattttgtatcctgaaactttactgaagtcattatcaggtctaggagccttttggtggagacattaggtttgtctaggtaaaggatcacatcgtcagcaaagagaaataattttacttcctcttttcctatttgggtgccttcatttctttcttttgcctgatcgctctgactaggacttccgttactatgttgaataggaatggtaggaatgggcatccttgtcttgttcccattcttaaggggaatgtttccagcgtttgcctgttcagcatgatgttggcttggggtttttcatagatgactcttattattttgggatatattcctttgatgcctagtttgctgagggtttttatcatgaagggatgttggattttgtccaatgctttttctgtatctattaagatgataatatggtttttgtttataattctgcttatcaattcactataagttctttgaagatgaaaactctgtcttttatggtgtttgtacattttgaatttcttaatactgtgtatgtagctgacaacacataaatagatatgcaaatgagtaagagagtcatttgggatcactgctgatttaacttatcttgccatgaaagcattctgttcctctttcccatgcttggtaatatatccttttggaagaaacactcttgccaaaagagaatggcattattacatccaagggaaatattatttgcccaagagtgtaaaaatgtatgaaagaaatatgtaaataaaatcctatatgtaaaatctaataatatcaaagtttaatgatgaaatttgtcaagatgattataaaatatcacagttaaactgtatattatattcatgtttcttgccatttgtatgctaaaaacttataatgatttgaatgtacaaaatcaaaaatcgggagaaaagaagatagatcagagcctattaccaataatttatcctttacctccataaatgtttgctagaaatgccaaaggctctaatttgtctatttaaatgtacttcaaaaaagcattccccaagttgcctatttactctgttatctctataaatcaggaaactctccaggctttccactgtgaatgttgtatggaattgatagaacaatttcttttttatgttgtactcattcaccatttagttacttagacaataaacttagaatgacaaattctaagtctcaaaatatgaatgaaaattcactcattttcagaacaaaatttagcatcacactctcttgagcaaaatctcactagaaaaaaagatagagaaaatacgttatagcatttgaagtctgctacctcatgtccttttatctgctttctaatttattagaaataaatatgcaattaaaatatgactttccttaacctttacataattataattattatgaaaaatatgtgtaaaaatatacatgttatattccttttctctatactaccaacagccactcccattcatgtactcatattagaagggaagagctttgaatatcatatataacattttcagataaaagaacttaggtccagaaaagctaactcttttgctggtgactaaacatacacatacgtgcactgacacacacatattaagttactgagttgatagcaaaaaaaaaaagtgcaactttatatggaagtagaattatgtaaaaatgtctgtctaattctatactggaaaatatctcatatgaaatggctccttcatatgacaacactcagtattcaaaagcaaagcacaacaactaagaaagttactttccccaaccaaaaaaaataataataattaaaaaaagaaatgtacctattgtggactagctgattggataccatggccacagccctgattttcagtaaagacatagtttcaagaatgtcattcagatggtttcttaagtagggatgttgttatttttagcaaaagaagccttttgtccttgtcacatcaaaacacaaagaattccataagtcagtgccagtcttgtttttaatgcctaaatatctggccacatatatatttatgttatgtaaatgttattgccttgtttttcagaataagaatttagaacattagaaattgacttttataatgcaatttttttcaaactctttttggcttttctctaaatctcaaaatttgtttcaatttaggcaatggaattggactagtcagtctaatttatttttgttagccagtttcacctctcagattccagggaacaaagccaaactataagatatctactgaaaacatttgtaagaaataattaaaagcagactctgaataagcatataaaatgaagcatttttatcacaagctttataaattttttaaaaactgtgttcatttaattctgaaagcatgcctcttttgtaattatgaaatacagaaatatttgaaattccccagtcatcttggctcacaaatagaaacatttggttgcgtttggttcacaagcacacaggggcctgctgcttttggttctgtgtaaagcccatactatttcttgctttttttttccacaatgagtatgtgggtgctagaatgttatcgaaatattttgcaagacatgaatctaaaatgagcactctgctatggttgcagttacagtgcaaaccccatcaagttgctagcattggactgatagacaaggtaggggcagccagagagtctgagttcctgtgaggaactgcaagggggaaggggctgtgttcaggggctgtcctgcaggctgaaggttgttattagttgtgtggtttctgggcccacacaaaactccaccttctcccattagaagtcagtgtcctgttgatgtgaccacctgctttattattcggggttttctgccatctaagacctgggccactcacctggatttttgaactcttgcttttgcactgatacctgattcagaatccgatcaattgcctttccatctttgtctgtggggaccagaagtacagaggtcttataggtgagcttttattctttcttccagaaagagtatcctataactgtgtcagtgaggaagtgaaacacaacctcctgtttgaaacacaaaaggaatttagagaggagtaaaatacagggccgtttaattattccctttaataagaagcagcatccccaccaaagaacatgtcgatcttacttggtgatacatttccctatggagaagggagatctgattgaaagaagaccgaagggcaggagggagggagggttgtaaagcaaggatgtggctctgtgtaaccgggataaaagcaccctgccttagggagatgttgtgagaaataccccagcaccctcctgctacaagaggcaatccttatagctggctcttgccatggttaaaatgattgggacaaaaatattaaaaaagaaaatgctcctcgctatactggttggaatcctcaggcttggagtaggaggagctgagtaatccctgcagtgtcccgaaagctggaatcctgagtagattcaggccaatttgtgtgatattcccagggattccctccctattttgggcagaggaatggatttggatggggcagcatgttcctgtgagttggcaggcacccactgaacagaataactgatttggtacccagactgcagataccagctgaattgccaagcagatattgcctgagggaaatacctgctaaagttgaaatgatcactacttggatgggttaaacatttaccagtatcaactagtattatacatagtgttttagtttttctgaaaatgtgcatgcacatgagaagaataagtattaagatgaaactcccagtccctctccagaggcacaaccatggttaccaatttcttatataaagtatatatataaaagcttatataacctcttcttttacttattaaatacttgcattgattactttagaatgggcaagtaaaaactagtttaattgtaataattgtaatcactctaatacattttcttattcctgaatatttgctttgttttaaactttagcaattatgaaccttatactagtctaggaaaattaatctgtaaatatttctgttggaatctcagatttataattaaaaaattatatagggtatgttacataatttctgatcaaagatttagattaaacaaatatgtttgtgcacttattacatcgtcagcactgtcctgtgcctcactcaatacgtgaacttatttaatgtaagtccacttaatttcactgtagaaaccaaggagaaaaaggtctggggcacatacatggcattcttgtgaatctttctgaaagtgctctcttacctgacatggtagggatatcctgaaaggtaagaagggaaaccttcagggcagtgccatttgcagctaggtctttgagaataagaatgaattcttattcaatatgctggtgccacagttagggctaaagtatctttagacctgccatctctaataataacggccatttctgacttgttaatcttcccggcttttttccctacaattttaggtctaaatcttccatgtaaacacactctttcatgctgaatcctgctcaaataactgccaagatgtttgtttagtaatcctgaaatagaagattggcttctatgctaagataattattgggagaatctcttcttttaataaatacctggttcttctcaaacccatgccaagaagaattcttataatatcatttcttctcaaacccatgccaagaataattgtcaccatatcatttcttgctattcatcccttttaaaactaagaaacaggccaggtgtggtggctcatgcctgtaatcccagcattttgggagaccgaggccggtggatcacctgaggtcaggagttcaagaccagcctggccaacatggtgaaacccgtctctcctaaaatacaaaaattagccgggcatggtggcgcatgcctgtagtcccagctacttgggaggctgaggcaggagagttgtttgaacctgggaggcagaggttgcagtgagctgagatcgtgccatcgcactccagcctgggcaacaagagcaaaactctgtctcaaaaacaaaacaaaacaaaaaaactaggaaacattaaagcttccaaggaattgagcgttaagtggggtctaacatttaatatgactgtagagtaactcctctttactaagtctttttactagtttctccctttctctcaaatatgtacagtttaaattggatgggtaaagcaaatgggagagtattgctactttttagtcatatttatacaaatgaattatataatattaattgttcataatattccttgtaatttatagcactgtgagcagtataaataatttgataagcgctgggcctgcccagcctttgtaatgtcttgtcaagagtagattgagaactgtgacatgatgttaggaaatggagatttacaagcttactgaagaatataactgaggcattaggagtgcttttctgatcggattaatgttcagttttattttcaattttatcaagtgagtgttaatgagaaatttagttggctccagtaaaatcattatttttttcctatgaaacatatgaaacctaaaataatagtctaattgtttcatttttatggcttcgaaattctagacaaaaaaaaaattctagacaatgtaaatatttaaccagtaaatattttgatgcattaaatcgcaaaatatcttttataattgctgcatctctcttccaaataactagaacccaattcccattttcacttttctcacataaacatgaaaccatttcttatagtctgtaaacatttctacataagtggctagaacatatactgccttatgtttaattgcatgagacccgaacttatttagtgagtattttgaaaagcagttaaagaaaaaagatgatgaaacattaatggctcccttcctccaagtagaagataagagtaatatacggtcatggagttcctttttaaggggatgtattagttttctatttctgcatataaagtcaccccaaagctttgtggcttaaaacaataatattttattctctcatggtttctgtgagtcaagaaattgaacaaggtagggtagagatagctggtctcttgttatgtaatgtctaaggccttagctggaagactctaaaggttgagggctgaaatcatctgaaaagttgttcatgtctggtggttgatgctggctgtgggctagagacttcagttcatctccatgagttctctccttgagggttagtttgaacttcctcatagcataatagctgatatccaagggcaagcatccccagagagagtaagaacctgttagaatctgtgtcctttttatgctttggcttggaaaccacagagcatcacttcaaccacacttcatgggttggatcaacaacaagtatccttcaatattcaaaggaaaagaacgtaaatccaactcatagattctaccagtcacaacgtaaagtaacataagaagatctgtatattaatctttggaaaatataatatgctatgggaggagtggacacaggtttagctaatgccaggttagggttttattaagtgggacatgaaagcttagagcttgaagtgacgagaaagagggagcagggttggatggggtgagaattttacggactgtggatataaaggggctgcattagtcagttttcacactgctataaagacatacctgagactgggtaatttataaagaaaagagggttaattgacacagttccacagaccttgggaggcctcaggaaacttacaatcatggaggaaggggaagaggcatgtcttacatggtggcaggtgagaggaaaaagagtgaagagtgaagggggaagagccccttagaaaactatcagatctctttagaattcactcactatcacaagagccggatgggggaaactgcccccatgatccagttacttctacctggtctttcccttgacatgaaggggttatggggattataatttaagatgagatttgggtaggggcacaaagcctaatcatatcagggacagagaaaggagaagtgaggaggctgacattatgagatggattttgagggaataacagagatgtttaacggggatatttatggagctttgctgtgtggaatgtgaggtaaaattgtttctctatatttttataatctttagaggaaacatcccactgggttgtagagttggatctatttttggacaaaatacattaagttgctgaatatggcttctatgtagagggagggaaaaagtagaggcctactaaatctaggttacatctgttacatctgctttcagaaaaacttagtaataaatgtggctgtcatgttaacgtttggtggttcctaaatgtcattgcaaagactgaagccagtccatggtaaaattttcattggcaagctctgaaatcagaaattagacatcatgaatctttcacaaagctaaatttgttcaattaaatgaaatgatctttattgtgagtttatatccttccaaactttttagttttaaaatgatcttttttaagaggaaatgatggtgacagtagatagtacttgtgttttggatttttaactgtccatatttggaaaagtaaaaagttactgaccaccatactttagtttctaaaacactggagtgcaatctctaaattgcaatgtgtttggggaaaaaaattcaatccctttgcattaggtatttttattgacattagatataagagaatagtataaatttacctaaatacacagaaaaataatctttactctttataatcccaaagaaatattccttagttcttttttcttctatttactatcaatatctatcacaaaagctgatattacatgaaaatattaatataaatgttacaacattatctttcttacgcaggtttgttgtgaggattaaataaattaatatttatgaagaactttgaatcatgcctagcatgtagtatggactcaaatattgctaataatattgacaattttttttgaaattgctcttcttctgtaacactcaatttatgccattggcataaatgttttgagctagacaagatattgctctattcagagttgccctggaataacttgtttctttaatcataactggtacttttttaacctatttaagctttaaattatccagaaataaaacgaggaaaaaagaagaaattaaaaacagtaataaaaccaatttctcagaaagccaaaagataacaacaaaataaactttaactacaaaagtctttttagagaagaaatattcttatccacctcatagcctagactcagtcaagggaaagggcagccaagaatatcttaagtgatatcctgggctttgttttcttgattcaagtagtgttcacattattataattatatattcttttatctgtatatctgtctattcatccatttattcatttgacaaaaattgagtatctgtgtttgagagacacaaagataaataagatatccacatccctccaggaaaatgtagcatctattttataatacttatgaatattactgaagatctaattataaaataaattaaatcatttatcaaatataaattctattaatatgagtttatatgaccacctataatgataacaagtatgagttccctcttttacttttatctggccttccctcaaaagatagagctaactacctagctactgggctgaaaatactgagttattagcctttgtgcatagtaagctggtggtcttagatcagaggtatatggcttttttccaaagacactgtgagatacgcagaacaaaaatcagaaaactataatcttttaaatgaatcatgaagtaccaaaaatgtaaagatctcttaataaaaataacatttaggatagataccatcagaccagttctgtactctgcctatactattttgaaaatcttccttaaagaagctttaactctgatgtttgaagtggctcatacaatgaaaataggtttaaatgcttattaatcacatgtaaattaaacacataacttttgtgttataatcataaagtggatttgctttgtttcatgtttcttcttaaaataatataaagcaaataaatgaaacaaaaatggaggtgtcctctgctaggtctacagttatataaggaaaaccggaaagataacataaaaatctccctaaatcaggtctatacagaaacagatttgctggatttagagagtagataatgcatgtaatctcaaatataaaatatagcaggtgactttttatggggaagttttttcttaatgttgatagtaacatatctgtacttgacattaattaatccatatcgtaaagatttgaaccagagaatcaggcccacttggtcatagaggcagtcaaggaatgggctctccactacaatttgatgtgaattgtctacttatcatgtctcatagttaaaccagatagtttggtagattctttatcacgtgtgtttctaatacaaccaggaaaacctatcgtatattctttttttttttttttttttttgtgagacggagtcttgctttgtcgcccaggctggagtgcggtggcacgatctcggcttactgcaagctccgcctcccaggttcacgccattctcctgtctcagcctcctgagtagctgggaatacaggcttccgccaccatgcccggctaattatttttgtatttttagtagcgacggggtttcaccgtgatagccaggatggtctcgatttcctgacctcgtgatccacccgccttggcctcccaaagtgctgggattacaggcatgagccaccgcgcccagcctatcatatattcttacattctctctcacacaaatgtgcatgcgcacacacacacatgcacacatatacatcattctgacactgccttaactttcagaatacaaggttgagtcctctgccacatactagcagtataatcctggatgagttacttaaacttactttgcttcagtttgaggatgaaatgagagaatatgtgtaagacatctggcacacatagtgagcattcaataaatgttaactataagtaggtgaccagttggggcccaaggagattgtaacttgcttaaggtcattaaggtagttcgtggctaagtcagaattagaatctacataatgattctcaattcaacctcctttatactaagttatctcactaattggcagctctttcctgtgttaactttctgtacatgaagggtttgccttcccaagtaagttgtaagcatctcaaaggttaaaagcattgtgagtgatatcttcatcaaccataggttctaatagagacttcttgctatttgtaggggttcagcatttatttgttaattatgagctttcaacttcacaatagttaacctgaaattgttttattcatcccatttttctcattctgtcttcagtagttctgtatataagaacagcaagccattatcattctcagcataaaattagaattgcactctgcacaactaccatcctctccctctgtaagtcctcagagaaaatcatacaattttctactatatttctgcagtatgaagaaaataatttaatatacctatgctttggtttctccatatacagaacttatatatggcattactcaatcaccaaagaattccattataatttagcttattgttatgtaaattcaggcataacccaggccacaatatgatcccaagaatataacaagtatccatagggaaaacctggtagaataactcaagagtgggaattatttttagctttggatgacttttatataaaggagctccactcacaatacattagtggcactattaactacactcgctagtaagctaatatttgaggtccattttttacatctctttgagagtatatcagtatatcaagcattacaaattactaccttgattgcctttggagctactctttttttgagacagagtcttgctctgtcacccaggctggagtgcagtggcaccatctcagctcactgcaacctccacctcttgggttcaagtgattctcctgcctcagcctcctgagtagctgggattataggcgtgcaccaccatgctcagctaatttttgtatttttagtagagacagggtgtcactatgttggtcaggctgttcttgaacttctgaccttgtgatccacctgcctcggcctcccaaagtgctgggattacaggcatgggccaccgtgcctggcccttaagagccaacctagcatatccttgtaaatcagttgcctaaacaagcttcctcttaaatatgcctttgaaaaatataaattcctctctatcagtatctacatttcactttgaagatcttatcggctttcagcagcaggtgtgcatatcctacaagtttcagttttctcttgatgctcaggatgaactaaacatctagacaagggagcatctgggaagtctgactaactggactacttggactggtttgtcctcacaaaatgtaagacttacaatctgtaggctgttacctagctcctgagagctacctcccccgggccgcccacactagatttttagtcctgagctgcatacccaggaattctcctgtttccgtgaatcaggaaggatatggcaagttaagagagaaggaaagaacctgctgagccttgccttccaagggatatcaggaagttactcaaaagacggcaaagtgctctctacacaaaagtgctggaagaactgcagttatattccctttaggaaaggaaactttaagatgatttggaaatagccaaatgtaatcacataacaaccaattttgaagtttgctggcatgcaacactcctttaggaattcttggtttccagcttggtctcattggcaacaaatagaatttcctaagccttattaggagcctgacattttgtttgagaatcaaaacttttctgtttgaaaactagagccaaactcagttatataaaaacagggatgtaagagaaagagcaaacaaggaaagctattatgttatatgtgtgcagaacataatagtttgaagagggagacttctcgatggaccagaataaatactagaatgtaatacacaactcggttatacaaggtaaaaatgagttactggcccttcaggatgggtatcatgatagctcattaatttaaataactcctaatatgcgtgtagcagtttatcagttagagagtgctttacatgggttgcttttcacaatagataacttagggcaagtgaaggcctgggtctgaaaacatattctgcaaaataagcccctcactgttaaaacctggcaaatgctaaggactccacagctagagcaaatggcttctatagttgaataatctttcaataaagttagaaaaatgggtgtccttcttcaatgcatagcatgttgggaacccaggatactttagaaagtctcttggtccagcactccgacttgtgaaagacaaatattgtcatacaatgctttggctgatctcttatttcttgtcaacctaaggtacagtgggtattaaactcttttagcttcctgaagacaaactaattcccgacctccctgtaataattgctgaacatgggaagttttggggtctgagttttaattccaagtaattcattatgtctgtcattgtctgtggtaggttgcttgcccaccactttgccagtatcattatctgtgacttgaggcaaatggtaaggacagcttgtctgagtctcagcacttgggtggcagatgtgacagagatagataaattggccagagtgagtattttaaaccagaatactgcccccaagcccagtatgggaccatctacagtatggaaggcagctcagacataggtcagtttgttcaggagaccacacattatgatctgttgagctgttcatcattttcacttgaaaatgaggggtggctgtttttaggctgtcagcctcagatttgaattctatagtgattaggtggtgaaatggctgctctctgcagactgctcaggggctgttagagctacacaattgccctaaaatcaacaggagcaaatagcctcaccaaaccagccttgagtcattcctttaagtgagggtgattaggagggtcagctatttttaagaaagaaattcaataatcagtctgtccagagactcaaaattatttatcatggcattttccaatgtcacctttcctcaccatcactttgttggcattaggctttgagacatggttctcaccagcaagatggttatttttatgtcttatcaaggtctctaacaggtcctatgacacgcaaatgttagaaaggagaataaagcaacaattgagtaaagcaatagtacagtgggaagagagacaggaagatgatgttgccatgttttagtttaatataaattgttaatatctttgtctcagtcactgtatagaaataaaatattttcagattaaaagatcctagatcttcattgaatcctacctctcttaacctcagcccttttggaaaacagcacaaactccaaactgtaattcaagctctaaaataaaaggctgggctggatccaaagtgttttcaatatttttctggtagatttttactggtttttcatgaaaagcacttaattcaaatattattcttccatcttttaatgttttagtcaacagtaaatgatactctcttctgatatactcctctcaaagtggtagaagagtttgtggcaaattgccatttcaaccatttattctgctccaataatgcagtattgaatacactgaagcacggaaaaattaactaaactacttttatgcactttcaaaagaagcaacagaaaaacttggcaaagtaataatagtgaaattttattgcttctcaatagattaatatacttaataatatcctagaaaatgctgcactttgaaattttaacatgtaacagtgtatatcttaaattaaaaataactgtatagtccagggtggttatttatactttatatagtctatattctttgtgagatttgggtttaaacacatcagagtttaaattctgcgaagactgcagagtaaagaagattaagatggagggaaggaggaagagcaggaagagggaaagtaggtatagaggaagaagagaaaaggagatagtagaaaggggaaaggaagatggcagggaggaaggagaaatacctcaagtccatgaggggttagtgctgaaggataccttcatcattaagtaaagggtgaattgcactgggttgtttaaaagcatgcccagatactgctgggtgcggtggctcacgcctgtaatcccagcactttgggaggccaaggtgggcagatcatgaggtcaggagatcgagaccattgtggctaacacggtgaaaccctgtctctactaaaaatacaaaaaattagccgggcgtggtggtgggggcgtgtaatcccagctactcgggaggtgaggcaggagaatggcgtcaaccccggaggcggagcttgcagttagccgagatggcgccactgcactacagactgggcgacagagcgagactccgtctcaaaacaacaaacaaacaaacgaacaaaaacaaaaaaaaagcatgcccagatacaatcctaaagtatgcccagatacaatcctaatgcaaaattttatcagatggaaaagtatcaaaagctggaataaatagaaaaaggagttcatgaaatgtattcaaagaaattttaaaaatagctcaggtacagaatctgttaaagcaacaaagcagacacatgactcttcttaatcttccacacttgactccacggcattaagttaacacttccttagtctcctctgagttgagacaaatttcctgaaaggaaggttgacattccctggacactttaaggatctgtttgtgcctcatgggtataggttgtaaaagttctttgcatagatatgtcagcattttagtgcattgtttggctccaagtgacctttcctccctgcatttcctcatttgccattcatcttcttgcttcccttcgtctgccataatagtccctggggtatagtataagtgcttctagggcactcctctaactgcacggttattgttactgcacaattaaaggacttagatattgaaaaatggtagtgtttggaattctgcaatctcattccttaggggcagggaacaattggaacacctaaaaaagggtcagagtccagaaccagattcaggagagagttcagctttcaattgggttggtccatttttcagtgctgcccgcacgagctgtcagttgctggaactgcagagtatttcaaggaaaggcgcggctaagcagaggtgaaatctttagacagatgagtctcaaagaggaaattatgcagaagccaaatggctacaaatggtactgaggattgaaacctaaactataagtgaaggtctcttccctaaatgatacactcagacttaacaataagctaataaggtggttcaataaagaaaatgtgggtctgatggaagagtagagagtttagaaggtgagtaagagatatctatgatattagcttgggtgtgtttttggtattgatgccattgtgttgggagtacagcagaaggacaaagaactcctttagcaacttggcctgcagtcaaataggccaacattggaatctgagctccactgccttcttcacctgggactaatcacttaccctctcagtctcctcatctgtaaaaaaaaaaggataataataataataattgttacctttggaaaattacacctttctcttctgtacctttaacctttctctcaactagatactttccatgagactcaaaatacattcaagtgtcttctgcattaaaaacaaacaaaacaaaaacctcaccttcaaccacttatttccctatgttagggtttctcttgacgtttggggctagataattctttactttggggctgttctgtgcgttttgggatatttagcagcattctttacccatgaaaatattgtgtccctcgccccacaagttgtggcaatcaaagttgtctctagacattgccaaatatctcctggaaagatgcccaccccccaccccagttaggaaccactattctaatgactgcctcatctcttgtctcccttgcaaagccacacttgcccagttttgcctattctctctagctatattcctcacttccctatcacagccgatcctattctagtctgtctcttgttcccattttaccaataaaatcatttttagtaagaagaacaataacctggatagttctaaatgtaatgaatattgcaattcttctcttccttgatttctcacaatttgaagtgtgttcttctcctggctcctctgacactattctctctcggcttgatctgtgaagcctgggtctcctggaatagctgcagcctttctctccactttcttaccatattctctcactgtgtccaggacactagctcagactttttcaaatgctgattaaagggcttccatgctgacagagggcaaacctcacagagcaagcttttcttaagcttttgcttatatcacatttgctagcactctcttggccaatgcccagagtcacatgggaagagcctactgaaggcagaaatacagagagagaagacttttggcataacatcttgagggcttcctttaacccactccccagtaaaactagtgaaaactatgatcaaacaaataaaaactccaagcacttaaatcctctggaaatgatcctaaggacaaatagcaaatgaagaaacatctattcaagaacatttatgaaaattcaataagaaaggcaagcctgtggtatttaaaccaagactgctccctctcacccccttccaagttcagggagatggagcttccattccaggctggtgcaatcaagaacacagagctctctcccctccagctggaaggtttcttcctggaaggaacagaacttcagtgtttctcatcctggccatagttacccattgctaaggctaagctctggtgaatacagtagagaggtaggggcttcctcccctgccaaatcccccatcattgaatggaggggataccttaggcactgcatgctaagaatacagaggcctcatcatccttgcctggcctcctgaggtgggggttccacaccaggagagataaatatagaagatattagagtgctgccacctcccaactaagctaagctcctagagtgggagtttcatgcagtcatgcaggaagaacctctccattttctccacctccatcttgagaaacatggcttagagattttgcctggtggtggcgggggcaataatccatcataaaataaatattcttaatctcttcccaaagggcatggcttcatttgcaacaaagtatggaaaagttcaagccttagagtgcgctcaagaacagtggaagctatggtgaaaggcaattgggaggagagtcaagatacaggctaaattgcagactagtttgcaggagagaaccagagaaataacacagctgggaggagccctgacttcgaactatttcttcaaaggagacacaattcgattgtattagtgtgttgaacaatataaggttgtaaagcactgttgaaaataacacagcaattgttcaccaattagtggagttgaacagctgaatgtggttaaggaaagagtgaaggacaatcacacgaacatcactctcatgccggctgggctgtctgtggacatacccaaagatgtacctccctgatagcaaactcagtgacttaactgagggaaattaactcacctgactgtgaaggaaatatacttattaaaataatccagcccctcactaaacaaccaaagaataatagcaagccctgggtggtggtagggggagtaagaagagttgctacagtatattatctgcaatatccactttccaaccaaagatcacaaagcatggaaagaaacaaaaaatataacccatacacaggataaaagaaccagatggcagaaactatgggtgagagggacccagatgttggatttaatagagagatggagaggagaatgaatgcagccagtgtgcaatgtgtcatgtcctctaaatgttcaagtccctcaagtcatagatccacctattttttctcaagttaatatctctacacctagttttaattccctgtcatgtatacaggactcacacattttatcttcaacttaggccttccctctgagctccggacctgtgtatcattcagcctttttgaaatctctatccatatgtctcaaaggcacttttgattaaatactaccaaaaattaactccctctatctcccagtgttctctatttcagtgaatgataccatcaaacatctactttcaaaatcaaaactctgagataaatctctaacagctccctgcttatcaccccaccccatcatattgaaaaccaaacccatttaaatacctttcgtttgtgtcctcctctctctacctccaccaccagtactgtagtgtaatctgccatcatctctcacatggattactgcacaagtctcctatctggtgcccaaattaggagcaccctcctaactggtatccaatctaatctctacactgtagccagaaaaaatcctttgaaattcaaatctaatcatggtatgtgcctcccccttcttctatggagaccataggaaagaaaccgaaactcctgtggtgcttgagttgatgctagtaacctctaaacctcatttcatgcctggatctgtcacttcctgaagctccatgataaagcacagcctcctcaccctccaagtgcgggggttctctagttgtctcttccaggtgccaccagagggacttctctcataaaaggcctgtgcaccctatgctctttctctctctgttatggacttccttccagagagctggtccccattccttgatatgggactgtccacttgtatgagtaataaaaatccttctctgatcataccaaagaattggtgtcatgagtttttatattagaagctaaacttgagagggaacttccccatgtcacagtgaaggtgtgatgataccctctttctaccatctttaaattcttccgtcgcttccattccattttctcttaggataaagttcacaatccttaggttggcctacaaggtcctctacagttaggtacccccgtctgctttccttccttccttcacattagttatgctccccactgcctgaaaacatgcagacctgctgcatcctctacctgaaatactcttctcctcacccctgccagactttacctaatttgcccttcgtttgtctttgtaacaccgctcagaaatctcttcctcagaaaggccttctctgacacctcagcacagtcctcctcacgaggtcagatgtattttttcttcaaggcactgactttggtttaaaatttgtatttattcatgtaattatttggagtgcatttatcttcctcactagatataatcaccattagctcaagggctttatatgttttgcttgccattgtgtcctcagtgcctaggccattcactgacccacagtaggtgctctgataaatatttgttgagtgtagaataaatgaagacccttagaagcataaaatatataatctcaaagcagaagatactttagttagaataagttaggttcaactatattaacactccttactacacacacacatagctacactcatcaattttggtggcttacaccaaaaaggcttatttcttgtgcacactgcattcttgtgctttaacaggatactccgccctacctcatctttattacagaccttggctgacggaggctaccacttggaatattgtctattttcaaagtccagcagaagagaagttaagaagggtttcactctggcaattaaatattccagctaggaaatgacatactttatcttcatatacaatccattggccataactagtctcatggtcctgcccatttgtaaaggggaaataggtaatcatctcatgcattgaggaggaaagaagaattagatacatgtgaccagtagaagtctccttactgacattttaatgtagagctgtatgtgattaaagttaaaattgaatctgaagggctgacagaaaaattcaagaggatatgatatttaataattgaacgaggctgaaagatgaaatttggacagattgaatgggtaggccttgctagcaggaaagacaaaataaacataatcaagaagtatgtatgaacgtgtgcccagggcagtgaggagtgatcagcctccttgaagtggaggatgtgtgtcaaggaaccagaggagatgattagagtggcagacctgattattagcatatccatgcttctgtctgaagcctttttggcctataatgtagaaatatccttggagtaagcagttcagcatatggttttagacatataggtcatcttggctggattgcatattcttcatttttaaaattccaggctgtattggttgatatgcagtccagaaagagctggatctgacttaagaaaataaaaactgctttaatccctcttttcagcccattgtctatccattagcaggtaaacaccagtgtccctgcaagtgtgtgaactgagcttccttaatttcacctttaattggcacttctagtgacttaactgagtgaagagacccttagcaatgatacaaagtgaaggatggtatagaataataggttttctgaaaacctgaatgcaattgaagggtgctatttaataaatctgtccctagaagctaatagcacgtagtcaatacaatttagcctattttctcccatgttacatttgttagttgtactggttttggaaaaggaaaagtcatgctgttacagttccactaatagaaaacagataatttgggaggaaattagattggaataaaagcacgttgttaaacaagaaatcacaataaagtattgagtagagagaaaccgttaatggagacagctatgtcatacctaatatgccctcttttcattgatccttagaggaagcataagatcgcagctaagtatggtctcttgagccagcctgccatgattcaaattgaaactccatcattcaccactgtgtgaccttgagaaagttatgtaatcattcttggatagtgattcttactgctatggacagatttgtgttccccccaaattcaaatgttgaggcaactgtgtgaggagagagggcctttaggaggtaaagttaaatgaagtcataaatgtagggtcttaattcaataggattagtggccttataagaaggggaagagttttctctttttctttctctacttgcctgcaccagggaaagtccttgtgaggacacagtgagaaggtagctatctgcaaactggaaaagagtcttcaccagaacctgaccatgctgacacacagatctcagacttgcagcctctagaactgtgagaaaataaatgttgtttaactacccattctatggtattttgttatgacaacctaagctgactaatacactcacctataaagcagggataataacagtgcctatatgatagtgtgtttacaaggatttaatatatgttagtttatattattttatgtccatatatgttagcgtatatattattttatgtctatctctaattcctcattgaggatacttaagaattctactttccatgtttgacagacctggtttggatttcagttccacctcttgtaaactctattaccttgagccagtgactaatgtatctaagcctccattttcctatctgtaaatggggatgataactagtgctgcttgtctcttcaggttgttgtgaggattaaaggagatatgcatgacaattcatctgccaggtagtaagcattccaaatatgctatttactgccatcattagaggtttgctgagcttcctcttttgcattaagtaagagactattctctccagaaaactttgaactacatgatggaggaacaaataatagcagtttctcctcaaccttggaactctaaaaatgttttttctaagccattcttatctttattttgtcattaaaagatacatgcattgtgcattttgcttttatttaatatatgccatgagtgtctttctccctatcatgatgtcaatgttacattacagattctaaggagcaggggccatatcccttaaacatgatttatttaaaataacaatataggattggatgtgactactgcttttgcaatgaaactgaaagatgggagagtgagatttttctcacagctatggagtggcagacctgagcactaaaatccagtctcagaacccagttattatctcacaatgtgaaggcaggaatctatagacagattattgaacatctcatgtatcatatcatgtatatcattaagcttatatgtatgacaaaatagtattttgtgcagcagtgcttctcaaacattaataaatgaatcacctgaggatcacattaaaattcagatgctgatcagggagtctagaatgggactgaagtgctgcatttcttttctttttttttagactttaagttttagggtacatgtgcacaacatgcaggttagttacatatgtatacacgtgccacgttggtgtgctgcacccattaactcgtcatttaacattaggtatatctcctaatgctatccctcccccttccccctaccccacaacaggccccggtgtgtaatgttccccttcccgtgtccatgtgttctcattgttcaattcccacctatgagtgagaacatgcggtgtttggttttttgtccttgcgatagtttgctgagaatgatggtttacaccgttggtgggactgtaaactagttcaaccatcatggaagtcagtgtggcaattcctcagggatctagaactagaaataccatttgacccagccattctgttactgggtatatacccaaaggattataaaacatgctgctataaagacacatgcacaggtatgtttattgtggcactattcacaatagcaaagacttggaaccaacccaaatgtccaccaatgatagactggattaagaaaatgtggcacatatacaccatggaatactatgcagccataaaaaatgatgagttcatgtcctttgtagggacatggatgaagtgctgcatttctaacaagctcctaaacgatgctaaatctgctggtcctcagactactctttaagtaacaaggatatagttggttttagcaatagtgacttaaagattttttgctatttttgtttttatctacccatttttgtattcactaaaatgtgttctggatgcaaacttctttaatacaaagggaaaataaattaaaagccaactttgcaagaattgaattacacacattttaaacttaaaatgcttcggttcatttctctgtatgttgtgtattcctaaatcattcacaatgtctttattttttaccccttttttatcaaatgaggaagtagtactcctctgacttttttcagtttttatcttccataacacattaaatcacctcaaccttcctaaaaagctctccttgttttctgacttttactgtcttgagtctccatttctcaacccctaagtcatgcccaaatcctgttctctgacattttctcatctctcttactttcttctccttgggaactcccatccactgccacatattcaaacattaaattcagctctctatacacttctgcatcagtgtctttcattccaaagtcttttctaagttttattcttctatgcccaatggattggatacttatgacctcacagccctttaaactcaacatgtcaaaaaccagaattcatatacttcttactgttaggccccaagccatctgcccacaaccaccaggttatattgttccctttatcaaaattttcagtgattatatttacggtggaataaatttttaactctttattctgacattgaaaattgtcgtctctccaacttcaatatttttttgtacctatatcttccattgcttttaaatatgtggttgacttaagtttgcctgaatcctgtttccagaatgtgcctggaaactcccaacctccatgccatttcactctgaatctaaagatctcgtaccaatctttgcttattcaaatgttgcatatcttttaaggcctacacgaaatgctacaacttttgtggtatattctctaatcccttacctgaaagtgattggtccctcctctgcactgctataatgcatattctttgctatttagaagacagcccatgctgcactatatattatagatctatgcaaatatctgccactatctgaaacttcaaggctccatctcttctccattattcctccaaacaccactcacagcaggttgttgtcagtaataaaattttattgaaagttttggggattatgcagggcaattatagcagaagcaggaatcaactggaattagagtgatagaaccacagcccttagacatgtatcagacactccctgaccaagtctgtccatggacacagaactcctcacctccagatacttcctcttgcatctcttctaccagtatcataaccctcacaaaaatgacaaaactcaatgccttttacttcgttatgcagtaatttcccctcttttgttactgtttaaactttccagcgctttgagaggccaaggtgggcggatcacctgaagtcaagagtttgagaccagcctggccaacatggtaaaaccctgtctctactaaaaatacaaaaattagccaggtatggtggccagtgcctggaggctggggcaggagaatcgtttgagcctgggaggcggaagttgcagtgagctgagatggtaccactgcactccagcctggaggatagattgagactctgtctcaaaaaaaataaaaagaaaaagaaaaccctcaccttctataatcaaataggtttttaagtgttttcctaagcttgatagcacttcagtctctcagaggaattctgcagtcctgcagttgtcttgggtcaaccagccaaaagttaactaatttgcataatggcagccccataaaatgcgcaaaattattatcttttatatgaatgcttattaatatatatatatatatatatctccttttacatctatctagaaaacgttttaagggaagaatcatatagcttcaaacatttttgttaattacaatatggaagaaaagagagttcaattccttaatctatcatgtgtgagttaggggactttaagcaagttattttcttaggaatcctgtttcctgacctatcaaatgaatgtaagaatagctacctcacataagtgtgaggacatagataatttctataaaatcatttagttagagtcttggcacatagtaggagccctgctctcagtacaagtttaaaatgtctgttgaatgctaaaagattactccattgagctttttcaaactttaaagtgagtatagtgtttcactgtaggattccaaaagctgtttgatgctatgatttctttctcaacatcatgtttactctgaagacatttccatagtgttctacccttaattgaacagagataggaaatcacgactttaaaactttcagcgttaagagtaaatgacacattagtttagagacatatcaataattatggaagtatcttctcaaactgtaatgttttcctctgccttagtgctagcaatcaaatccactgaattaatctgagcagggtcaggactttgaacctgaggaaaatcacttgaatttgaggcattaagtgtgcagtacaaggtgttccagctacaaattttctgaatcctatttcaaagcaatggtgcaggagaccagatagccacctcaaaacttctgagtcccatagtgttttggtatggctccagaagcctgttgctgccccagaaaagggagatttcaccatttctaaagggttagctgctccctggggatgacagataggtggcaaaaattggaatgtagaaattttccttatgttctaaaattgcacagaaattttctagggaaatattctttatagatttcccaattttgttgactaatctcttcatctgaaatgtttccctccatgtatgaattttctctctgtctttctaagtccagtgtagaatcgatttggtatctaccgactttccagattcctccaagttgggataaatcatcatttcctcctctgtgttcctagtgcatagaaataaaatcatttatcacaatctttggttactgatgatggtggggaggtctttacagtgtgatggcttgaagtacaaagtacaaacttgaaagtcagattaccacttactttggaccttaggcaggttacttaaccccactctgcctcagtttcctcacctgaggacttaataatagtagctaagcaaatgaacttactaatagtagctactttatgatttttattaggattaaatgtaatggtgcatatgaaattagtaaacaagagttgcaaagtagaaaactgtcagtgaatgtcagctctctctattatccctcagagactcctcctgccactttaggtagaaagctccttaataattgtgaccataacatgtttatttctttgttggtatagtcagtgctcaatacattatctgttgagttgaactgcatttttgacaggagacaacttaagttataaaaatcctattttctatttatactatcataaaagtcgtgatggctatgcttttaacacttgacctacctgaatgtggatggtttctaaaagtaaaataccttttaatgctgtttagagtgtatggcaggatcagaaaggcatatgtgccatggcttgaatatttgtcttctctaaaactcatgttaagatttaatccatggccgcgccccacagtggctcaggcctgtaatcccagcactttgggaggccaaggcgggcagattacgaggtcaggagatcaagaccatcctggctaacacggtgaaaccccatctctgctaaaatcacaaaaaattagccgggtatggtggcaggtgcctgtagtcctagctactcaggaggctgaggcaggagaatggtgtgaacctgggaggcggagcttgcagtgagctgagattgcaccactgcactccagcctgggcgacagagtgagactccgtctcaaaaaagaaaaaaaaaaaaaaaaaagaagaagaagaaaagtgtcagtatagagaagtgagacctttaagaggtgattgggtcatgagggttctgctctcaagaatagattaattgatttctggattaataggttttcatgggattgggactggaaggagaggaagagagacctgagctggcatgctcagtccccttgccatgtgaaaccttgtgccaactttggactctgtggagggtccccaccagcaagaaggtgctcaccagatgcagccccttgaccttagatttcttagcctccgtaactgtaagaaagtttcaggtattctgttataagcaacagaaaatggactaggcagcatgtaaaccaaattaatcaacatacacaaatttttgtagcactattttactcttttatataacaaataaagccttaaaacaaatactattttgaaagaaacttacatgaaatggtcataagcataatttaaactttaaaattacatatgtaaagttttcattgtccaaacatgttgatagacaaaatggaaaagataaatagtttgtacagttctctcttcttgaaaagtattgctttgattaaaattcatattgtcccaacattgtttaattcataaatagtaaaataaatatggaacatttttttcaatgcagtatttgttttccttgaaagctttcaaaagggagagacaagaatccccagaatattagaaatctttcatatttttattacaatcactgtaatcctgaatatttttttctagcttgaagcctaaaattaccagtactttaatatacaagatgaaagtttgtttactcataccactgcatattattgtttgaaacaatcatttctggcaatagtcatacctctgcgtattattgtttcaaacaatcatttctttcaatgactctaaataaaaaattcctgcttctctttaaaaagacagtgggaataagtttctctccttgagcaatggggcccctactctgcctggttttcttcccctttcttagcacagacaccactggaagagctgagccctcatttaagattgattctatattagtttcctaaggattctttaacaaatgactgtaagctgggtggtttaaaacaacagaaatttattctctcacagctctggaggtcagaagcctaaaatcaaggtgttagcaggacttgttggttctggagactttaggaaagagtcctttccttgcctctctccttgcttctgttgattccaggcattccttaacttgtggcatcataactccaatctgagttgatggaagtagagatctccatcagtacatggtctttttctctctctgattctcttcacttcttctgttctcttctaagggcacttatcattggatttaaactccaccctaatccaggatgatttcaccttgagatccttaattgaattacatctgcaaagatcctttttccaaataagttcacatttacaggttccagatggacatatatgttatggggccggtttttttttttttttttttttttggagacggagtctcgctctgttgcccagactggaagtgcagtggcacgatctcggctcactgcaagctccgcctcccgggttcacgccattctcctgcctcagcctcccgagtagctgggactacaggcgatggggccgatttttaatccactaacaggtaccttgagactagggctcactatactttggtcagagatgctctaggcatgaagattatatttgcatgaagctaacattttttcaagactacgtgattgcactgctcaaacttacattatggtttccagagacagctagagcttccttgttcattaactttgaaaggaagcattttccctgggaagaggtgcccaagcctcttttgtaaggtgggcttgtcttaggcagtaactaagcctagagtcaggtctactaataatccattaagatgctgtgttagaaaaatcctctccaaatatgatggaaataagtatgtataagaagtatttcacagatgaacacattcccactttattaaccaagtgcctgtgtgcttgcttaaatttttcacattttcagacacttaacatattatagaaaataacatccaaagagaacatgatgtttagctttttggattctttgggataaagagcaaaccaattttgaattaaaaaaaaaaagactgtagataccacatccttaaataactcaaaagttttgtaccaaaggctactttttaaagttgaatcaaaatgaaataggtgtgaacacctatgttttgagaggcagagaaattggtttttttaaaaaagtgggaataagtgagtattttttaaaattgaaaagggtgtagattgggttcctcagagattgctaaagctgatatcataaattacctaaggacagggagaatgaagtgaattgtgtaaatgtctacaatattatacttttcttgcttatactaagctaaactagtatggatgacatgtagtaaaagttataaaaggaaattcatcttcacctgtgtacatgcaaaactgctgcatttgcagattaagtcaaaattatatatagagagagacacacacacacataacacacacacacatatattgaaaatctttaagtacatctaattttttatgactcagaaaagaatccttatttaagccctttttactacagcaaaaaatgttaatgtccattaaattaatggactttgctctgatttggggatgataattgcagaaatgagtagggatatatatatgatctaatatatagaaatggatatatagaatatatatgtatatagaatatatagaaatttctaatatatagaaatttctaatatatagaaatggagcattttaaggtctggaactttggggctgtcaacagttataagaaaatataaagagagatatatacagagagagtaataacaggtagtcccaggagtaggacaggagattagtggcccagaatcaataccatatttgttctatttcatctttttgcaagacaaaatagatacccagggggctggggaaggtgaccagtaagttacttccattattttctttttctttttcttttttttgagatggagtctcactgtgttgcccaggctggagtgcagaggcacaatctcggctcactgcgacctccaccgcctgggttcaagtgattctcctgtctcagccccccgactagctgggattataggcgcgcaccaccacacctggctaatttttgtattttcggtagagacggtgtctcaggatgttggccaggctggtctcaaactcctgacctcaggtcatctgcccacctcagcctcccctattactttcttcctttatccttttctactgtttaaaagctcaaaacttgttgaaactccctctccatcagattctgtgtgcccaaagaactgtccttggaggagagtttcaaatgtctttcattttaatgtctggccttggtgattgtttaagaagtcccctgaatgaatttttgggtgaactcggggcctagactggctcaggaaatctggcactgagccccatatttactttggccaaacacaatacttgctgtgcagccacattcactatgcactgctcacaccacgcagcttgagagctttgtccctgattcaaatctgctgggtattattcagtctgaaaatttacttttacaccaagcatataaacaaaatgaaatacagtttaagaaatcagctcataacatttacaattaaattcattaatcaaggcagcttatggaaatgccacatgtgaactgtaaactttataaatattcaagtagtgaacaactagacaatcacattggcagctttgtttcagtataagtgatgtagaatattaccatccatcagcttgcagttttgttttaaaacttgttgaaccatgtatatcatcaaaaagaacttttggttacatttctgtttccatatgtttcccatttaccttcctctctagatttatgtgccttcgtactaattagcacctgcactgaattcagaaagcagcacttgaatcaaaccaagtcaagctgtctgtgaaggaaaaaaataccaagttccaagatttcttgttaatggagatgaacagtacactttgttgatgttcttattcacatgtgtcttcttaaagtatgagaatttagtatatgttctttcagtatatgcaaatatatccacatgggtattttcaaactatgctgcagtgtgctttgtctggttaccagtttttattctagtacaagaatgcaggatgttattcgtcacattcacactatattaatttaacctcctaggtctgggaggagagaggaggaaaattaaaggaggcccaagctttgcatttgagagaaaaagtgaactgggtcttgaaagatgtcttaagaaacaaaagagagaaagaaaatagaggaaatgttagaagttgaggtaaaagtgtgtcatggagtaaagaagagcatggagagaatactattagtcaagagaaactgcagctcaaacactcaaatgcagaagcatcataaacaagctaaattccactcttcctttagttcatgtgttttggtctatgtaagctgaagacaaactctcctttttccatgctcccatacctcatagaatgtgtttggaagtattctctcctcttctatttttcagaataaattgggaaaattggtattacttctttaaatgtttggtaaaatgcagcagtgaggccatcagatcctgggcttttctttgctgggagactgtttattattactttgatctcattacttactattggtctatttggattttggacttcatggttcaatcttggtaggttgtatgtgtctaggaatttattcatttcttctagcttttccaatttactgccatgtagttgcttatagtagcctctaatgatacttctaatttcagcagtatcagttgtaatgtacccttcttcatctctgattttatttatttgtgtcttcttattaagatgctatgttagaaaaatcctgtcagagtctggctaaaggtttgtcaattttgtttatcttttcaaaaaatcaactttttatttcactgatcctttgtattgttttcttcatttcaatttcatttacttctgcactgatcttgatcattccttttcttctgctcgtttttggtttggtttgatcttgcttttctagttctttcaggtgcatcattagggttttttgtttttgaagtttttcttctttttttgatatagggtataaactgccctcttattactgcttgcaactgtacccgttaggttttggtatgtttctgtttccataaccatttgtttcaagaaatgtttcaatttccttaatttcctcattgactcactgctcattcaggagcatattgtttaatttctatgtgtttgtttagtttccaaaattcctcttattgatttctagttttgttctattgtggtcagagaagatactttctattatttcaattttttttaatgttttaagacttattttgtggcctaacatgtggtctatccttaagactgattcatgtgctgaggaaaaaaatatgtattctgcagccattgatgaaatcttctgtaaatatctattagttccatttggtctatcatgctgatcaagtccgatgtttctttgttgaactcctgtctaaatgatgtgtccaatgctgaaagtggagtgttgaactctccagctattattgtattggggtctacctctctctctagctctaataatatttgctttatatatgtggatgctctagtgttgagtgcatatatatttacaattcttatatcttcttgctgaattgacccttttatccttatatagtgaccatgtagtctctttttatagtttttgtcctgaaatttattttgtctgatataactgtaactattcctgttcttttttggtttccatttacgtggaatatatttatctatccctttattttcagtacatgtgtgtctttatcagcgaagtgcatttcttgtaggcaacagattgttgggtcctgttgttttatccattcaactactctgtgtatttactggggagtttagtccattgatattcaatattagcattggtaagaaagaacttactctgccattttgttgttttctggttgctttgttttcttctttcttctttccttccttcctgtcttcattttagtaaaggtgattttctctgctagtatgtttttaatttcttgaattttattttttgtgtatcagttgtatgttttttgatttgaggttactacaaggtttagaaatatcatatcataactgattattttaagctgacgacaaattaaaactgattgcataaacaaacagacaaggaaagagaaaagtaataattttacacttttactttgtcctcctactttctactttttaactttcattgtttcttttttttttgagatgcagtctcgctctgttgcccaggctggagtgcagtggcgtgatcttggctcactgcaagctctgcctcctgggttcacgccattctcctgcctcagcctcctgagtagctgggactacaggcgcccaccaccacacccagctaattttttgtatttttagtagagacggggtttcaccatgttagccaggatggtctcaatctcctgacctcgtgatctgcccgcttcagcctcccaaagtgctgggattagagacatgagccactatgcctggctgtagttattatttttgattggtttgtcttttagtctttctactcaagatattagtagtttaaacatcgcaattataatgttatactatcctgcgtttctctgcatatttactatcatcagtgagttttgtatttttaattgattcttattgctcattaatgtccttttcttaagaaatccctttagcatttcttataggacaggtctgttgttgatgacatatcaacttttgcttgtctcagaaagtctttatatctccatgcatgaaggatatttttgctggatatactattctagaataagaggtgagatcttttttttttttttttccacactttgtgtatgtcataccactctctgctgtcagacattttggagcgccactatatattatttgtttattttctcctgttgcttttagagtcctttctttatctttgacctttgggagtttgattattaaatgccttgaggtagtcttctttgggttaaatctgcttggtgttctataaccttcttgtacttgaatattgatataattccctagctttgggaagttctctgttattatccctttgaatacactttttatccctatgtctctctccaccttctctttagggccaataactcttagatttgcccttcagaggctattttctagatcttgagcttgtgtttcatttttgtttgtttgtttttctttcttttgtctcttctgactgtgtactttcaaataacctgtctttaagctcactaattctgttttctccttgataattctgccattaagagactctgatgcatgtaaattacacttttcaactacagaatttctgcctgattctttttatttcaatctatttgttaaatttatctgatagcattctgacttctttctctgtattatcttgagtttcactgagttttctcaaaacagctattttgaattttctgtttgagaggacacatctctgtctttccaggattggtcactggagccttatttaatttgtttggtgagatcacgttttccttggtggtcttgatgcttgtgcgtgttcatcagtgtctgggcgttgaagagttaagtatttagtgtagtctttgcagcctgggcttgtttgtacctgcctttcttgggatggttttccaggttttcaaagagacttggatattgtgatctaagtttttgttcactgcagctatgtctgcattagggggcaccccaagaccagtaatgccatggctcttgctgacccatggaggtgtccccgcttggtgttcttgaataagatccagaagaattctctggattactaggcagagattcttgtcctcttcttttactttctaccaaacaaatggggtctgtctctctctctgtcttgagctacctggagcttggggaggggtgacactagcacccttgtggccaccaccactgggatggcgctgggtcagacctgaagccaacacagcattggatctctctcaaggcctgcaatgaccagtacctggctactgcatatgtttgctcaaggtcctaaggctctacaatcagcaggtagcatagccaacaaggcttgtatctgtcccttcaggacatcaagttcccctttgccctaggagaatccagagatgccatatgggagccaggacctgaagtgagaaatcttaagaagctacctggtgttctattttacgtgactgacctggcaccaaagctataagacaaagacctccccgttcttccctcccttttctaaaagcagaggagactttccctgaggctaccaccaccctagacctatggcaagtgctgcctggctactgccagtgtttactcaagatccagtagctcttcagtcagcttgtggtaagtgaaaccaggcctgagattctcccttcagagcagtgggctacccttttgctgagggcaggttcataactgctgtccgagagccagggcctggaatgggagatcccaagggcctgcttggtactctaccctactgtggctgagctggagcctaagctaaaagacaaagtcctctttacccttctttctccttttctcaagcagaagcagtcttttcccataactactacagctgggaatgttctgggtcacacctgaagccagcatttctcagtctcaccccaggcccacagtgagtaccacctggctattgctgctgattattcaggggccaagggctctttagtcagcagatgatgaatgctgccaggactgcttccttcccttcaaggcagcaggttcccttttggtccagggtatttctaaaaatgtcatccaggaggtaaggcctgtaatggtgggctcatgactctgccttttgccctatcctaccatggataagctggtatccaaattgcaagacaaaggcctctactcttccctctcctctccttaggtggagggaaggagtctcacctgcagctgcaagctgctctgcctagggttgggggtggggtggcacaagcactcctttggctgcccctgctagtgtctcactaggtcacatgtcccccataaacactaattctaaacccatcccagcatcagtacttgcccaggaatttcagtctttgtggcttagactgtcgttcaagtttatttagtaccccagaacactttaacttatggcagtgaggcttgctggatttcagattctgactgctggaatgggcaatttcactctggctagggctggtctatattctccctccactggcgctagctgagttctgcccagtgttgctttccactgtgacagggcagcactgagttccaaagcaaagtcccccagtcgctgcactctccctcccccgagcacaaagattcactctctgtgccacgtggccactgctgacgcatgggggaggggtggcatcggccattcaagactttctttcctaccctcttcagtgcctttttcactgatatatagcttaaaccaggtacagagattgctcacctgatttttggttcttagatggtacctttttgtgtggatcattgttaaattttgtattcctacaaggaggatgattggtggaggcttctatttggtcatcttgctctgcctttccaaaataatttttattctgtaacatgttgccctgttacccacaaaattgataaaccagacttccttatcttcacccaggttgttggttaaaatgcaaaattagaattctggatgtcctttgaatcatgtttccaggttaatctcaagctattaatcaatactgtctgagtacagtatttaaccagcaaccagcaattaatctacccaagagactatcatcaacatcacatttcaaacaacaaaaatcaatgatatggttacaacaaaaatcagtgatatatttaatagtccatgttttttttctataaatcaatattgcgtatctggcactgtagtactcatatctatcccatttcttttgttgaaattctcaataacctcaacttttgatttcaaatgttaggccttattatatttaatgagaattaacactacttaataatgttcatattatatgaatggccattatgctgttttcgtgttttaaaaaaagtttgcaaaaaacattaattttttgcctaaattattttgaacattagacatgttatattttagcaaccctaataataataatttttaattattacacttaatatcctgcccactttgaaatattgacatcatagagcttatgtatgagacaggtaattaagtagttaacatttagtaaggatgttttatgtggcaggtactattcttagcattatacacccattaccgtacttaatgttcacaccaacactatgaggtagacactttttttaatatactttaagttctagggtacatgtgcacaacgtgcaggtttgttacataggtatacattgccatgttggtttactgcacccattaactcgtcatttacattaggtatatctcctaatgctttccctccccctcccccctccccccaccacatgacaggccccagtgtgtgatgttccccttcctgtgtccaagtgttctcattgttcagttcccacctatgagtgagaacatgcagtgtttggttttctgtccttgctatactttgctcagaatgatggtttccagtttcatccgtgtccctacaaagttattatcctttccagatgaagaaactgaagttcagagaagttaagtggcttaccaaaagtcacacgaccaggattcaagcctggataatgtggctccagggtctgttcccctaaccactatttcataataaggactatcttccaactaactctgtatgttacatactgctagttcaaagccaggtagacgaaaaaatactccctgtttcagctgaagaaggttttccaatatatttttagctgcaaatataaaataccacaaagccaatttacattaaaggagaattgtacattcaacacatcagcatttccacaggattgtagaataatatattagaacaaaaatagtgtttgtaatagaaatacagttattttactttggagaatgggcttggaaatggcagagataagaattataagttatttataattagcttaataatttcggtattcttatctgcagccatacagagttatgtgagttgtgaactgggataggacattaaagctgacagggttacatctggatcagaaacaagacaaaaaagatatgcctcttcatgagcctcatcaatgccccagcatatattgttattgctagcacaacattagggttttgtctaaattttacttatggttttagtgtattttaaaatatttaaacaataaattttattttacataatctcaattcaagatttcatacttatatcttttgttatcagagaatattaattaaaatttaccatgtacatagaagaaatagatatataatatgcctcatttaataatagggctatgttattataacaaagcatctgctctgtctttctctcaacagaccaaattaatctttgccacattattccttggacatttgagaggttaaaatatatgcgcatatacatgtaaaaccaatttgaaaaataaaagttcccaaatgtttattcagtgtctactttgtggcaggcactgacctgagggccgaagaaaaatagggagggtctttcccacaagaaggaagaaaaggaacagatggtgcatgattaccaggttcagtggtttgcatggagtgctcttcaagcactgataaaaagtgtctaaatcagattagatggaacaatgtcagatatggcttttagaggatgtgaatctgacctcaatttgagaatgggtagtagttacctacatagggatgaccatttatgcataaagtacagatacagttaatcccactttttgataatgagggcctggaattctttcatatctaatgaaagaataaacctcctagaaagtccatgcagattgtatggtacacattttaattggtgcctaagaatgactgtagttggagaaaggaaggtgaaaactgaataatattcttgagctgagaatatttctatagccttactttaagcacacatcttaaatccaggctaaaactcttagactggcattggcaattagctatttcatggatataaactaaggagacttgacgttaccaacctgcttggggagtattttgctgagtctatccaactgttatcaattcgagaacaatactttttaatttgaatcaacctgtttttttaaaaaaggttttgttttaactaaattcatctgttctccccacaaaaagccagtttgtttgtacttacatatctctatgtatacatgtatatatttttgagtctgcaatattcttgtcagaataattttgcttccttgaatatttcaactattcaaaaatttactgggttaaaacaacacacacttactatctcacagtttccaagggtcaggagtctaggcatggcctagctggtcctctgcaaggctgcaatctaaggtcactagggttcagttttcatctggaggcaccactggtgatggatcaactcctgaggtcactcatgataatgagagaattaatttccttgcagccgcaagactgacggtcgcaacttcttggtggctgttacttatatcagaggttacgtatcagaggttacattagctcttagaagccatcctcagttcgctactaccttgccctcgccatagaccctttacaacaagcagcctgcttcttcaaatccagcaagagaggaagagagtgagtttgctagtatgactggattttatatagcataagcataagagtgacagggcatcacttttgccacatcttatttgttagaagcaacttaaagttcctgcccatattcaagatgaggaaaatataaacagttgtgaataccaggaggaaagaatcatgagggttaccctgatatctgtctgccacatcccaaaaagaaaatctatttcaggctttggtatcatttgaaaggtttccagataatcaggtagtcaacattaaataattgtttgaatgacatttaactattgcacaaacaggtgcctctttaaaaaaaaaatacacacacatatacacatacacttttttaaagcagagtccaagtgtgccagtaactgacttgagtataaagcttatttttttaatgttatttatctttcaaaccataacagaaaataattttatttcaaatgatggttatatatttttatcattattaaatataatactatttttctccaaatttatcccacaaattttctcttttttgtgtaattgattgtgtatagtataaaactataggtcactagttttagcaactgattgaatttaaactgattatgtgtttggattttctatataagctaattttaattacattaaatgtttatagcagtttgtaaaaagagatgcaatcgtaacattttattctatattattttaataaacaatctatttttatataacaaaatctataaagatattgacaagaatattaggttatattaaatgtttacaaatggtcttttagattaaataagttgcattgaaataatgtgcttcagtctttcaaattcattttaacaatttgttcagcaaatattttattaagcaagtgtcaagtatgtactaaaagcttacaacacaagagcaaccaagtcacatattatttgaagccctaaatattcagggctatgttagaagagtattaatatgaaataatgaataaggacattaaaagtcagagagtttaattgatatattataggttataaatttagggatcctaaaattgggattggagtccaggtcttctgtatcacagtttactggcctttcactacctcttgtagctcttaagtaataagttgccttcatttgtcagagagggtgatcagtgccctgcaaagttcttttcatgaagcagttatagctttgtgttgatccatagactctctggtttgttccccattgagaccagctaagccatgagtcacaagctgatggttagagttcagcttggaaacatgaaacagaatgaggttaatgacacagatcagaatcaagcctgtgactttgttttcattagtatcatgctctacataaatttgctagccagtcgtagatgtcaaagtagaattcaatctatacattagtttttctcttcctcctttgacctccagccgtgtaatgaaagacttcttcaagaaggatggccgggcatggtggctcacacctgtaatcccagcactttgggagcccgaggcagatggatcacttgagaccaatagttcaagaccagcctggccaaaatgatgaaaccccctctctactaaaaaaaaaaaaaaaaaaaaaaaaaaaaattagccgggcatggtggtgcacccctgtggtcccagctacttgggaggctgaggcaggaaaattgcttgaacccaggaggtggaggttgcagtgaggtgagattgcaccattgcactccagcctggatggtagagtgagactctgtctcaaaaagaaaaaaaaaaggaatctatgtagttttatagatttgcaaaaaatactatattcccaatgtatgctgtgactcttaaaagtatttactaaatgttgccaatatctagaaccatctcttaaaaaatatttcaaacatatcagtgttaacaattaatggtgaaacaacaatgtgattaaatggtgttttaagtaggttttaaaaccaaattatatgtacattgcattggcttgtcagactctagttattaaatgcatcgattttaccctgggaacactcttatttccctacagtttaccttttaataagtgcagttggcacatgttttgaccagagttattatatgtcttattgttcactgtatgtctgggacttttttttgttttgcatgaacttggcagcaaattcaaaacttttctcacattaataaagctactggttaaaatatgtcaagggcagagtagctcattcttgtaatacggttgtatatacacacacctttgttttgttgttatagaaaatgctaattagtatttcctgatgacatgtgagcttgttgcatagattattttccacttaccttaggtcttggtgtattaggcaggctgcgaagcacagcttgcaggggagggccaccattgtccttttctccttcaaatattatataaaagttcaggaaaaaaagcattctcatagattatattttgtgactgactacccgtattttggggtttgtgtggtgtgatgagtagagattaaataatggaactaacttggttatagatagttctggggactaggagattaaagacaataacagatgtggggaaaaattacttttgtagaaatattcaagagaaattatttcagagaaataaatgtatgtttcatgtttagttcaatgttattttcaaaggattatgtacaagagaacccccactgtattttttccggagtgatgatgttcctgataatttatgtcaccaaaaagaaatgtgttctaaataaatgaaaattacctttagaaaaatacctgatttactcatacttcctattaagagtaagacacgaatatgagagggaaaagtaatacaatcctgacataatgcaatgccttagtccctagtgaggtaaaatatgtgatacatatatgtttaatggacattattgtgaagaatacaagaacaatgacagttatttatattgcaacttagaaaggatacaaatgaatggttttctttctcaaaacaaactgtaaaactaaggcaaaccattttcctttccaaggtctgctgaagctgacagctgccacaaagcttattcccagtgttctccaatatgtagccacaacaagttgttgagtcctcttaaataactaatgtcagttattaatataaactttagagtactcttaattgtgattgcaccatctctttccttggtttctgggaccatttctattcttcttcctatggactcacctttcttcagtgtccttttctgattccttctaatttgtccaattcaatcctcagactgttccattctgccctagctggtcatccattgactgacaattcacaaatctatttctccagcttcagccacaaaagagagttaatatgtccactctaactcagaatctctatagagaaatgtacaaattatactcaaggtagacaaacacaagtacactatgtttttgtactccacttgaagctttaatagattctctccaacttaatctgtcttaaaacaaactctggatttacaaccttcaaacctgctccttccccagaaaccccacttcactcaatagaagcactataatttgggttgctaagaccaaacatcttcaatttcttttcctttctttccttttacacacatacacacacacacacacacacacacacacacacacacacacacacacccctatcagtaaattataaccaagccttaactatacttccccttctcctacctacttcttccacgccgggccaagccagttatctttcttaattgttgaaatagcttccaatctgctatatgtatctccacacttgccattctaccgtctgttttcaacatggcagccagagtatgatcttcttaaaataaaactcagaccatgtcacacttctcaaaacctgtcaaaggcttccatctcattctgaatcaaagttaaaacctcttcccccaaacacacacacacacacacacacgcacatgcacacacacacacacacacacacacacatacatcttcctggctttgtcttttctgatctctccctcaacttgctccagccacacaggcctcctagttgtcttgccctgccccacagactttgtcctgacaatcctgtctgcctgtaatgcatttacctagcttccctcaggtctctgctcaaaaatcacctcaacagagaggactttcctgaccacatcttgtaaaattgcatacctccctctcccaggctccttacctttcccaggctccttaaccaccccccatctttgtttttctccacagaacttattatcacctgataaaatatgtatattaatttgttgtctattgtctactttaaggatgacagggattttgtaatatttgtgccatagtctagcacctaggacatgtagtagttattcatatgtattaaataaataagttatatgaaatatatcatttaacagctgtttgcacaagtgggagtcaatatgtcaatttcaacttagaatttctgtagagaaatgtacatattctactcaaggtggcccagactattcttaaaccatatttaagaaggtgaaatagagatatgatttgatggtttttattattatatggttttcagtattggatacagcagtgcacaaattatattaaaactacaattaaaaactacaatttcatgccaaaaaaaccctgattttactctgatcatccttcaaggctgttgttcttgattctagcattgatatttcatgtttatttcattacattttatactattttaaaatattaaatatttaaagcatatataagctattttcacagttgatttgcattaagtggaagttaatatgtcaattctaactcagaatttctaagtagaaatatacatattatgcctgaggtagacaaatacaaatatactatatttactataccatgactatttagtatctttaatcccataaaaattaattacctgacttatttccaccaaagctcttctaattaaagttttggaccacagtgaaagaaaataagctttaatttatatgtattaaattttgtatatcttcctttttctctctccaatggaagtcttatgaatgtgtaatttagacatgtttgtctagctctcacatatatgaaaggtgttactgttagcttttctaaacagaacattgtaacaactgccacacctacaaccccattcagccagaagtgcaactccccaagctttgggaattttctactaaaggacttgaaagagtcaatgtttcatagttaagttgggattaaggaaccatcttgaccacagatttctgaatttttttagtatataataatcattggcaattatcttgtccaataccttccatataaaaataagaaaaaatgaaatattcctcatgcccttggaaaattgctggcttagttttcttttccctgtaatggcttaccatctggtcattcaaactgggccagccacttctcaaggctgccacactagcctattgctccttccatgatgttttccccaatgtttgtatttctggttcctccatgtcattcagttctcagcttgaagaacacttgtcagggaggtcttctctggcacccaatctaaagcagccttcagtcacctactagcatatctcttattttatttttcagaataacatgcctcactatttcctttctgaagtgtttgtttttagatttattatgtgttattgttcatcatggtacattaaatacagagggtagcagccttgattgttttgttcaccacagtatccccaatgagtggaacatttcctggcaattagttggtgctcaataattatgtatttaataaatgcatgatgtaatccttgttacttttcatatttgtattagtgactaaaaaccatgagggggcctaagaatgtacaacccaacaaatacagactttccaccagccacatcatgggccatttaaaaaaacacaaaattaactgatctaattgtcgtaagtcttcagagttatatgcccagttgtttttgacattgccagactactctttgataaacctgtcaatacaattaatttgttgataatatgcatatctcatcaccaagtgcagtcttactttcctgcatctgaaagaagaaagacaagaatgctttctgcttcctcttgacattttccttcccgggaaatattttcctcaagtatttaaggtgagttacattaaaatatagaaaaattagcttaaatcttttcttatcagaaaaataagctgatcatattcattcaacaaatgatttctgagcacctactatatatcaggctcttctgtcattgggattggtttctaatggaaggagcagataacaaacaaataactagacggcaacattcacgtgttattatatccttaccacagtcctttgatgtaggaattatcattcagactcacactgccagctgcagagttgggatttgaacataaatttctattagtttaaagcctcctccctttgtactttattgtttggaaaaagaatattctatgaaaatttaaataataataacaaaactgtgagtcttatagggctttaaaatcattataatttatacaaaaaataaattatccatttaaacagagaaattattcctatgttttggtcatagaaactaagtgcattatacattaccataatacattactttaaacatctaaaaaatgaattatagtataaattagacctcatcaaaagatcattcagttacatagtttatcagttattgtccaaagtgttctcagtaagacagctctaattgctttaaagtgtttaatatggcagacattagattctggtaggtggataagccaatctttaagtcaaccgatgctcctgtaactgcccagtgggttcattttgcctcctgcccagacagagccaatttatcaaaacaaacgaattgcaatagaaaaagtttaattcacgcagagcctgctgaacaggagaccagagtcttattattactcaaatcagtctctctgaaaattcagagactggggttttttaaggataatttggtagataggatgccagggagtgctgattggttcggtgggagatgaaatcatagggagttgaagctgtccacttgagctgagttggttcctgggtgagggacacaagaccagatgagccagtttatcaatctgggtggtgccagctgatccttcgagttcagggtccaaaaaatatctcaagcaccaatcttaggttttacaatagtgatgttatccctaggagcaactggggatttttagaatcttgtgacctctagatgcatgattcctaaatcgcaatttctaatcttgtggcaaatttgttagtcctacaacagccagtctggtccccaggcaagaaaagagtttgttttgggaaagggctattatcatctttgtttcaaagttaaactataaactaaattcttcccaaagttagtttggcctatgcccaggaatgaataaggacagcttggaggttaaaagcaagatggaatctgttaggtcatatctctttctctgtcataattttttcactgttataacttttacaaagacagttttactcctatgataatccttcagttagttcactgtctagttcctgggagtctgttttgtggatcctaaccctaccccaaggattctactgcattgtaaattctgactttacatttaagacatggagttctttgggggcagggagataaatatcctattttaactatcaagggttaaagtgctttcaaggatctagtgtctggtggtgataccagagtcatacaattcaaattacaagcatctgtttgttgtgttgagagcagggactgataaatgaggcactttttgattgtgcaactgggtataaaacagtcaaaatgatgcttataacttcaagcttttctcccacttgaatcagccaacaagattttcatacaacatttagaccagagtagctgatgcttctgtttcttgcattttgtctggtttgggatcaattttgtagtcatggatgtagttatagctctttggtatgtgaacatgagagaggtgtaagctcataaaataagaaaatctgtttttgttaaagtagacgatgtgcaattcagaaacaatgaaccatatcaactaaataatgggttaaatcagtagagactttgtcaatcttgtattgatttaatcatttcaaaattatttattcattgtctataggtatgctaggagaatagttgaatacaaaaaatgttcttacactcaggaacttcacaatcaggtgcaaaaatgagacaggcatactcacattaaaaattaaatgacaattcaagaggcggcacaggcagtctaggataaactgccatatgaataatagcaacaataaagtagatgagctcccaaaaaggaaagatcgaggaaggcagcatggaaaaatttgacattgccttgtgtttggagttgaacgagttggaagtgaataagtagaggtttttccacgttgcagagaagtacgatggtggggggtatatatggggcattcaaaatgcatgaaactaggaattcgtttgtcatctttaggaaatttcagaagtagtttctgaccattttatgtgggtcctttattttcaagtttagacattgggattttatcctgagaataatggggaaccattgaaggttttctacaggggacaaggatagcatgttggaatgactaaccagatagaaatatgcacaatttcttgaaaatagggagaacgagaaaggaagaaagcagaacagtggttcttgactttaatgtgccacctaagggccaggtgcagtgggtcacacccgtaatcccagcactttgggaggccgaggtgggtggattgcttgagtccaggtgtttgagacaaggctgagcaacatggtaaaactccatgtctacaaaaaaatacaaaagtggtggtgtgtgcctgtaatcccgctgctcgggatgctgaagtgggaggatcgattgaggccacaacattgaagctgcagtgagccatgattgcgccagggcactccagcctgggtaacagagcaagacccctttgtctcaaaagaaaaaaaaaatccacctaaggagcttgttaaaattgccgattcctgaaccttactccagagattctggttcagcaagtctggagaggacgcataatctccctgttaagggttagattctaaataagtggtcttcaggccacattttgaataatactaaattagaaggctgtcacaataatctaggagtgaaatggtgaaggtttgtattataattttggaagcagggatgaaaagaaagtgatggttggtagagatatagtgaaggaagaattgataagacctagaaatgtttgggtataagaaatcaaagggaagaaatagttttaaatgatattaatgtatttatcatatttgatatttttgttaatgtaactggatttgcaagtcacttaacttactttaaaaagccagtgcaaataaaaataatgtacaaatgtaaaccaagttgaaaatataagatcaaatgatgggtatgggaatatctgtaaataggaaagaaattcataaaaaattaagctaccactttgtgttatttccaagtgtattctaataattagttttccccatcatggatttaattaattcttagtcaagatttctggatttctttaatcattaccttttgaaagtagatgtagaattctcaattatctaaatcttccacatttagctgagagaccaactctagggaatatattagagtattttcatagttccatcagactatgaaccccaattcttagttaaggcactatagctatgggaattatagtccatagtgaataaaatatacaatcatggaccttattttgaatagcttccagaacaaacatatgcgaacatcttgaggaggttattatggctaggttctagcttgcatcactaagtcatcaagaatgggagacaaaaggtataaggaaaagttttcagtagaaattataataattgtcagaggaattatttcagtctcaggttgatgcaaatttgggtacagtggatgctgcttccacttgttttcggaagccgtaaccaataatcaaaagcaagcaacttttccaaaagtaattccatcttgttttttaaaaaaaagtttgagtttatttaatatcttcatttagacatgtgaacaaattgtttgcctttttcattaatgacatctgagtacttgtgtagattgccttcatagttcatttgaggcataatgcctcaaattaggaactggaaatgtttctttttaaacatgaatattgcctaaaattgctgaaattaccaagtctttaatttcatcaacagaagaaaataggcaaagaaattcaggcaaattgaagagttaaaacgttatgtataggtcaggttcagttcagtgcaaataactgtaatattcctttatgttttaaagggatgtttggtttgagagggaatgctttcaccttctgaaagggaagagggaggtcaaatagtgacaaaagaatgaggacttgggggaagtttcagctaagaggacaagcaaaagaaggctgagaacaaacagcaatttgtggtgggcatgtttgggagctgtaaagagaatagctcttgctttggagtaaacttcctcagtcagaactaggtccttgaattcagaccagctctcatctccttggtccactctagggctgatggaggctgctgaaatcatcttttgctacattaatactcatttttcgctcaaagatgacaaggagtatttaaacgcagagagaatgttatttataaatgatgatttgttcgtgatagaacttgccacatagtattttctcttttttaacttttattttaggttcaggggtacatgtgcaggtttgttatataggtaagctagtgtgatggaggtttgttgtaacaggttattttatttcatcacccaggtactacgcctagtacccgataattattttttcttttcctccccctcctcccatcttccaccatcaagtagatagaccctagtgtctattgtttctttctttgtgtccacgagttctcttaatttagctcccacttataaatgagaacatttactaaatggatctttataaaaacagtttgccgaccactaatgaataagaaaatattagaataaaaaagctcaatgtcactgatcattagagaaatgcaaatcaaaaccacaatgagataccatcttactccagtcagaatggctgtgattaaaaagtcaaaaaaataacagctgctggcaagatttaggagaaaagggaccagtattcggttttctgttcctgcgttagtttgctaaggataatgtcctccaactccatccgtgttcccgccagtgacattatctcattctttttatggctgtgtagtattctgtggagtatatgtaccacattttctttaccaaatctgtcattgacaggcatttaggttaattccatctctttgctattgtgaacagtgctgcaaggaacattcacgtgcatgtgtttttatggtagaacaatttatattcctttgggtatatacccagttgtgggtttgctaggttgaatggtagttctgtttttagctctttgagaaaccatcacactgcttcctacaatggttgaactaatttacactcccatcaacagtgtataaatggtcccttttctcctccattctgactggaataagatggtatctcattgtgattttgatttgcatttctctaatgatcagtgatattgagcttttttattctaatattttcttattcattagtggtcagcaaactgtttttataaagattcgtttagtaaatattttagactttgtgagatatacagtctctgtcatactcaactctgccactgaagtatgagagcaatcattgacatttactcatgtaattacatgggtttggctatgttccaataaaactttatttacaaaaacagatagcgagctgaatttgtctaatagccacagtttgcctgaccctgtttcattgcagtatgtgctatttctattgtgaatgaaaaggctagcttagaaggctaactactttttctggcttaggaagctaactactttctctagcatagtttcctagagaaataggttctcgattaaaaatagataggaacctgacccacactgtatctggcaaattctttaactaaagaaatgtaaaacgctttggaggtacctaaatagtggctaaaaattgagttccagtgttttctaattatgagatgaggacacattttcctcatctgtaaattaggaataacaataccttcttcataaaaaggccatggctatcaaatgccatcgcataagtgaagtgcccactgcagcagcatctgacatagtaggccctccagtaaacatctgttttctcccttctccattgccaggaaacacatatggaatagaaataaaagtagaaacaaaggagagaagaaggcagaactagtttcagttttaaaatacagaagctctttatctcactaaaatattcattgccggcttaaaggcaaagccctattactagttcaacacagttcataattttcaaaagcactacccctgtcatggtactgtgggagttcttggttttttactcccctaatttcctaaattatatgtataacatcatatatggaatataataatgtatatatgcgtgtatacttaggtatacatgcattatttatgtaacagatattgtgctgagcattttacatctattatctcatataatctttacagtaacattgcaaagttgattctgttattttcatcgatgaaaaaactgacagagaggttaatgtaacccatctgtggttacacatctagaaagtcttggagctgaaacggaaactcagggcgttctggctgtaatgcccattctcttaataaccatgataaatgacatacttttaagaatgaataatatttaactgtgatgagactactgatttggtttagattcatcatttctaagttacttgaccaacatcaaagaagaactgggtcaattagtccaatctgtggtttataattggccaattagtccacatctttgaatctgcacagggaccacttgcacataaatctagatctacatttgccacgctccacaaagcattctgaacaattcactgtgttcaaaaatgagatttctattatttatgcatgaagaaaatatgctgttttccatgcactgagccagggggaaaactactcagccttggtaatattagaccatggatcttccatttattttaaatgatagtgtcatgctgaggaaaataatggttcatatccttcttctccttcctccaaatactatgtcaaaactactttgattaaaataaataaaatcttgtatcactgtgccaactctgtaagaagacagagcaagcaagcaaacacattaaaaactaaggtgttggagagtctgccgtgacttgtgaattctgtatattttttcctttcctgaagttcttattttcttttcttttacttaccaagttacttggaaatttaacaatttaataaaaataaacagcatcttttcccaatatttaaaaaaatgtattattcattaaaaattttgcattcacaaaaaagtgaataattgggctccaatctgagttagtttatgagtgttccccaggtacctatcctctctcttttggagagaacatgtattccttgaggacagattaagaaactagtcttcccttaatgctgggagcctctttgaagtcttatttacttcagatcttaagggagaattgtggtacgctgaaaagtatcacatttgttatcacttgaggaaacaccatttgatctaatgagctagactttttcatctttcaattcatgacagctatagctacattagaaattgcattttggaggtcttggataattatctaaaaatattcacaaaccccttggaggctaatgaatttaaacttggatggctaatcctaaaatggctttattccagcaaagtgggagagaaactccccttcttctgtttatttaaggtttctagtttggggtcctggttctagtttggagtcctggagttcctttcaatgtgtttccataatagcctgattcagaggagtcggggagaaagaaagaaacaaaaagaaaatgccttgtttattttatttacatatatacatacatatctatacatatgtaaaatgcacatggtaaagcatagtattttgcacaaaatcttaagtaaagacagacttgggtttagatttataataggatttagtaatactaataccaataacagcagcagcaaattcttgagtgcatgaaatggattactttatgtaatttctgcaaagtcctatcatgtatattttgtcactagtttattttacagatgaggaaactaaggctcagcaaagctgtaaaacttggccaaaaagtcatgcaatttttgaggattctgatttgctctgtctggtgcttatacccatcttcttaaatagaacaatcatgaggaaattgacaatgtccacagacataagacacgcttgcagagaactaggtattgggacactgcagagaggcaggcagggaacactggcctgaagtatgagctttgaaactggcagtcttcattgtaatcctggctttgcccttgctgtctgtgtgtccttggatgagttaccatcttctgtgtgcttcagtttctttatctgtacaatcgggatagtaataaactaatttttgaaaaccagctaaaataatgcctggttcatagtaaacccaataagtagtagttgtcaatttattaggttggtgcaaaagtaattgcagttttttttctattactttcaatcacaaaaatcgcaattacctttacaacaagctaataggtatcctgcctgctctgtcttatccctttcaccctttagagcagctaaacattagacgagtgcctcatccagagatttattgcaatattttatacatcagaacagtttgaagaacctgagataatattgagaagatagagaatttttctctgtcactccccatcttctattttaaactagtaattctcctctcttgcctgcaaaccccgcttcctaatccttaggcaactgtcctgagttcttgttagttattactaattcctgctgtgatgttcgttgatagctacaatgttagatgataaggaatattatattttaaagtcagatatttgagaaataaaattgcattctcactccaagaaaagtttctgcatatccaaaggatgtgggggatagatatttaggaatatatgtgtgccaggattgggcaactcgcagccaaagaatggaacaggtttaccttggatttgagagctacacacaccacttcacaaaaatttttatcttaatttggtattaactttatttaactataaaactttaaaactaaactttgagaggaggatgaattttgttttaaagatgtttgtagttatttttagctcagagttctatttaggttccccaaattttgtgctacaacagttttaaaagtctgcccagttatttaatctggggagattacaaatacagtgttgacgactggcctgcagctctctcttctgaaatgagatattcaactccacatggcttactgcctcttcctatcccacttagtttccatctcttctgctggtgatgatgtgagttccctaccctgtggggttacaattgcccttatggtttttcttatacaatattcagcattataacatatgtaggttatagagcatataatatatgaactgcaatattatcaatatgttgtatctacctgtgggctccttccttctctcagttaccatattttccttcaccactcactgggtaacaaccatctgaaatttcatgaattgcataacctttccatttttaatacttttaaaaaatcatatatgtatgtatcctctaaaatcttgctatgtaagtatggtccacagatctatgcatgaacattgcctgggagcttattagaaatactgaatttcagcattgccccagacctactgaaccaaaataagtattttaacaagaattgctgttgatttacaggcacattagtttaagaagcactacaccaaaatatattattttgtcttcctaggggttgttttgtttgcttgttttcttatttgtttcttgtttttgagtgttataagaatgacattctgtttgttgtcttctgctacttgctttgtttgctcaacagggcattttaagattcatccaggttgctttctgtagttgttcatggcttcctgatgtaacatttgtgctaatagtccttcctgctaaacacttagtttgtttctagcttgtgttatagtgtataatcctgctatgaacagtctggtgcatgtctccgtgtgtgtgtgtgtgtgtgtgtgtgtgtgtgtgtgtgtgtgtgtgtgtgtgtgtttgcatgtaagacattttctgtgctgtgtacccaggagtagaattatgaattgtagtgtatgtgaatgtttacctttaccagataatggtaaattgttttaccaccagcagtatatgagttttcattgatctacatcttttcaaatacatggtgtcatcaggctttttactttttgctgacctagtggacataaaatgtcctctcactgtggtctttatttgcatctccctgataactaatgagattggtcaattttttcatctatttaattaccattctgttttccttttctgtgacgtgccttttcatgtattttgactatttttccatttttctctcattgattcataggagtacttattttgaaatagtcctttgagagttacatgggttgctatgttttcttccaatttatgacttatcctctcactttcttgatcactcttgaatagaagttccaaatgttagtatagtttatcagtctttcgctgtaactgcttttgtatcttttaaaaaaatccttccttgcatgaatactataatactattctaataatttcagtggatgggtggtttaatacataattagagctctaggatgatattaactgaaatattaaaccagtcttcaactggtattcttaaataactcatcaattggcattttactttcaaaaggcctatgtttaatttctcccatttgtcatccaggcaagatcacaagttttggacttagcttgacgaggctcaaatccaggctttgaaacagcaagtatctgaccttagttaagtaattgtccccataagcttcagtttcctcatatgtaaaatagttgctgctacaattcttctattttaagaaatccgttaattacaatagttgagtcaatttaatgggagctttttaaaatgagaactattagtttaaatttacattttcttaagtgatttaaaaatgcatacattttgccttaccaatgcctacctaccacattacttttcatcatctcaaactataagattaaatcttttctacattaagaatctaaagatctttatacagttttagcctttggtagttgggcctaatttcaaagtgacaagctctttcatgatctcttttacatttttgagatcaagagtgacatttcaaggcatattgattcatttttataaaaaatataattatcaaccacaaaaagttaaacatctctaaaaagttagctaagagcttgtgacagatggacatttagcaactgagtaatcattcttcaggtctcacaaatctgtcactttgaaagttctatgacatcttctgagggatttggtaatatctactcattttaactgtattgctgctgtgtgactggccatgattttatagacatttcaatgctaaagcaatatgcagcttccaatatcattcttatgaatatcttgttgcttttcaataagatatggaagtgcagtttttctcccaggaagaaatattttttcacttatagtaaatctttgtctcctacccatgttttaattttcttcctatatacaaaataacttagctcttcaatgaggtattaataattatagtatgaacttttgaagacattttaagtaaatagtgtatatatatatgtgtgtgtgtgtgtgtgtgtgtgtatatatatatatatatttttttttgatatggagtcttgctctattgcctgggttagagtgcagtggtgtgatcatggctcactgcaacattcacctcccgggttcaagcaattttcctgcctcaggctccagagaggctggggttacagttgtgcattaccacacctggctagtttttgtatttttagtagagacagggtttcaccatgttggccaggctggtcttgaactcctgacatcaagtgatccgcccaccttggcctacaaagtgctgggattacaggcatgagccactgcacccagccaaatagtcttaatttagttaagtgcaaagttcatcaatctgtagctatatgaatgcaagtcagaaatccaaagtccttaccatgaccagcatggacttccttgatctgtcatttccaaacagctttcacctgacttcatcccaggccactggttgatttactattcctcagccataacaagctggctgccatgtctttgcacttgattttcccacagcctggagtgctggcttactcccttgcttccttcaggccactctaccattactcttttggataagcctaacttgccagccaatgcaaaatagcactcccaaacatcacactccaacttcttaatttgcttcagtttgcttcataacactgagctcctgtatctgatattattatttatatttctctaattaaaagaaatggaataaacacttaagcatctatatatatatatttaccacttaagcatatatatatatatttaccacttaagcatgcatatgtatatataaatacatatatatatatgtgcttaggtgtttattctgtcttttttaattagaagaggagggccagaacttttctttattgacttttttatctccagaacttagggttggcacatattaagtgctcaataaatattggttaaatggctgaattaatgttgagacaatcaggtgaacaggtgttttctatgtagagttaagagtccaacgggctattctcaacattggcagaggactagcacagttctttagtccccactgaaagactcatcctgatcattataatgttaaaatgtgatgaaaaaagcatactgttgcaagaattaaataaaataatgtatggaaaatgtttgccagaatcagaatatcaaatgttaattgttcaataaatgcaataaaattaattccatctgaatcaatccttaccccttcctttcctgtaacagtggaaatgttggcttttttctagtttgggcaaatgcttccatctgtgccctgcagttcaacgcccctcaaccccatcttctcagggacaacatattgttattttccttccttctgtcatatctgttatttctccctctctttgcatcctactcatcaactttaaaacctgctccactcagaagggggtccttttgataatgtatacaaagtcactacattgcctttaggggacactgaataagaagtaattctttatcaggcttctgcttattgctcagctgtccttgcaggtttatagacttatttgccattttctgaatgtccaatgccccacaatatctctcatctctaagttattgtctgcgccagtctctgcccaaaatgcctttactccttcatctccccaagacgtacacacattcatggtcacacatatgtattcacacatactgaaaatagctaatttcaatgtgtacttgaggtcttggcctcagattagatgccactctccctttggtgaggactcactgagctgtaagggttgaatgttcttccagcagacactacatatccgcatcagtatatctcttccccccatcttcccaaattatagttgcttatttatttatttcctctgcaagacacaaaactccttgaggatagtaattttttgtgcatgtttgtcaatgcagtatcacagtcgtcctgagaattagcacacagtagataagcaatatttttaccttgagctgacaagtggaatggtatcattagaaagttacaaaattgattttgtgatactgagcctccaactagttggaaattagtgtgctgctaaatttgcattagtgtgctagtcaaagacaaggatattcaagtacagcatttcttagtttcatattaattgcatatttctgtttatttcatattagacaaaaattactgaaaagcagcctaatatactgcgttggaaacaatatgatagagactttaatactagtacttgtactggcaatactgacaatattatcttgtatatgtataggtttttacaaatttaaaagcctttcatatatctcaaggaaatatcctaagaacctgtttctactcaacattaaagacctaagtgaaatctgagactttcaatgcctttggatatgtaattagacaggagtttagccttttgtaacacatatgatgatgaaaatttccgattttaagctgactgttgggcatcaagatgaccatctttacaaatgaagtagcactcatgtgctcaagtatacatagaatgtatgcaaagtgaaagtctcctttaaatcttcctcccattgacttgagcaacgagaacacgtggacacagggaggggaacattacacactggggcctgtcggggggtgggatgctggaggagggatagcattaggagaaatacctaatgtaaatgacaagttaatgggtgcagcaaaccaacatggtacatgtatacctatgtaacaaacctgcacattgagcacatggaccccataacttaaagtataataaaaaaagtaaaaaaaaaaatcctcctcccattgccaagatagaaatggacccttagttactgccacttgccatctcactctgtgttctggatagaaatggtgcttgctctctgctagctgttaattgacatcacttctgccagaactctccatcattattgacaagaatgttctcccttgttaattgcccagcagcacattgagtgattgattgtatcttttggacagatttgaaatgcatttgcagaaaagggtgggggtggtaatgacataatgcatggtaatgacaccaactaactgcttatttaagtttgttcaggaaaaagatactgatcatttacctgatttttactttttatatagatgtgctaatggtaagtagtgatagctttccaggatgtcccacattaacccaatgcttcacaaaaatctctctcagactgtgcccataaaactccaaaatctatggtcaactagtgggaaaaagaatggataatttatttaacatataagcagggaaaaccaatgggtagatggaatattttacatttttgttgttttaattaaaagtaggaaatacctagattaatgagaagagtttttaaatggaaggctgggagtgctcaatattcagcagtataagattttcttttagcatagaggcaactagagtaatacataaagtgcatattttcatgagaactttgcttataagctggacttccctagaagtatttgagacacaagggcgagtcaactaatagtatctacagtgtttttgcaaccatttaatgagagagtaagtctggatcagtagttgctgatgtatgaaatcacatgaagagttttttaaaatgccgatgccttgatcctcccctagaaatactgattttatttgtctaggcagggtagtgatgatcaaactttacactgaagcagcatcttctcacaaatttggtaaaagtataaagcctcaagccctatcctgcttcatggagcctgggtctttgtgtgctggattagctctcctggtgattctgataacatcaaagtttggaatcactgctctaggttcaacatcagacattttttttcaagctcccccaggtgatattccctaggtacagccaagactgggaactgctgattaacatgatatttaggatacttcccagcctggcaggaataataaaaattgctacctttattaaacattcattgcatataaggcattgtgctaagtattatttcattaaataattgcaaaattctgtgaagtaggtaatattagtactactttgcatatgggagacagggatggtaaataatttagctaaagtaacatgggtaggaagtggtagattggaactcaagctgtaacctcaaagatcacacaagaaactattactatcaataacattttggaattataagttaaattaaaaactctacaagttggaaacatattaaatgattttcttacattttaaaatgttcctgacttgcaattacatagtaaaaacaaaacaaagaatttttaaaaatcagtgggaaatatataaaagataaagttttcatgagtaaaaaggaaggagcaaattggtggtgaaaatcaggttggatttgaattattccaatttaatctggaaaaaaattataagtcacttgtactgttagtgtatgagaaattagaataagagtttcggatagaggtattttgccacagttatattgaggcgaaaggtggcaagcatttcaggggaaagaagaaatttgtgtacttctttaaaatggttttggatgttaataatgcaatgaattaaaagaaaaaggcagtctatactgcagaacacttccatttctctccttttgtgtttgggaaaatactggcttagtgccctcctaggcatggtaaatactttgaccactgccaccagtcacacttgtgtctgcaaaaggggcaaaaagagtgcctttgtaaagtatggtttaatcctacacagtggagagtggtgcttaggagattgccttgtttctcttaagacacaacctttctcagattttgtgtatagtccacatatgagcagagggctcatattaaactgatggaggaaaggtatatttccaaccataaataaataaatagcatgaagagatgatgaaggccttctcctgccacttgcacatttcgtggactgttcttgctgataaacaaagtgagcacttattttcattggcattattttcccagtggcatctagactgtgtggagagtgttgaattttcagcagtctagagagtttgagacatggttcctgattctggtactctagcatccattacatgatatgcttgaaatgtacatatgaaaatatgttaagactgagtgtgtgggaagaatagaataattacacagccaacaagttgttgtgagtcctaaatatattatcgttcaaataatggatggtacgtggtaacttccacaaagaaaaattctagaattattttaacagtaagcaaattgcatttcatctttaagtaatatggtcaaataaaaaaggtacagggaaaaaagtgtctatatattgccctgaaatcctcttggcttctttaaaaaacatttgacactgcaggaaaatgctaattaaaggaagacaaaagttgaatttggattctagtgcctcataggactctaatttctgtgaatattgatacaacatgtttttaaaacactttagtaatagagctgtgttctgctggaagtggcagaaaggcaaattgcaggcaggcactgaagatagagactaccgaagataatcagaggtttgtaattgaaaaggtgccttaaccttaactctggccagcgggctcagccatggctctgcaactaaggacgactcgccttgatttccagcgaggaccactcccgaggccaagttggaggaagatcttcaagaggaaacattgggcattctccctgctgtgggaaagagccacacaatgttttatcctatgtcagggaaagagactgaattaatcttactattggatcttcacccagatccaatttttcagcgacgcgcatagacaatattccaggcaactttgcctggtcacattccttatctttggaagcaccagcatggggctcatcgtcaacaagctctgagaaccagccaggaatcgccaaactccatttctctaagagcactgaggcaagcggaggtgaagaggaaggctccggggcagtggggagcagtgtggaggagggaggcgcgggcacggcgaggggaaggatcaagaggacaggtctgactcctgactggctggagtggttttggtgaaagtcacagctcgggcgtgccagcctggagctgtccaacttttcagcagctccgggatcagggttccggtgccctggaggcggctaccactgccgccgccgccgttgctgctgcttctgcagcccgagttgctgacaatccctgctctcgccgccggcgcccaaaggaagggaagaagaaagggaggaagaaggaccaacctctggcgaaaccgggcaccgcgcaccctagtcttggtgacttggggagcccgggagcgtgtctctgccatagcctcggtggaaggagccctgccgcgttctgtgacccctcccgctggcagggccccctctcggtagccctgaggctctggcgccttcaagtgagaagctaagcaccagcctctgctgggctgcagaagcggcggcggcggcagcagcagcagcagcatcaggaaggcgctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcggtgagtggagagcgccccctcccccattcaggcaaagggtcacctccccttttctcaaatactccatctaagtcggcttatcaccaccaattctagacccagggtaaaatgctagtctggaaattgggggaggacaaacaggggtgtgcctatcctttattgagagtatgctattcaggtgtgtgtaagagaccccccaaaagtactgcataaatgttaactggggccgtgtgtgtgtgtgtgtgtgtgtgtgtgtgtgtgtgtgtgtgtggtgcgcgcgcttcccagttatctgtgccacgcaccagccctctccccacccacttccataccaccctggctagtgagactaaacaggcaaaatcagtttgctctgggtggagaagaagagaaggtgaaggttttgcgggatttgaccagcgaaagcacccagcatctgtccactcaccctattgggaagagggtcggtggggctgctctgactggggaggaggggggagtgagaaagcctggtcccaggattgcagctaaaagcctaagaacaactcgcatttctcttcgtcaggtggagaagtaaattgaatagcaaaaggggagaacacgtgggtgacttggagagtttggagcaaaatgttcagcaatccttgagagagacaagggggtgagggagggagaaggagcgaggacgctgtgggagttacactgtgtcggtgtgtgcgagcttgtgtgtagggagaccgtgtgtgtatcagtcgtccctgcaaaatcccaggaagaaagcgccttgttttagcagcaggcaagacgtagagatttgattatagtgatttccccttaacgtaagtgctccggaagacagggcagggaagccgcctatcaaccgggagttttagtagaagttgaccgctgcttctccaaggaaatgagtaaaggaccaattacagccattctgaggagtcagctccagattcttaactcaggcgtggaggtggatgtggggcccacgtttggtccctttcctgataacccagggacagctcctttcttccctgtcccaggccttccacgccgtgaatcccctcccccacacaggcacaggaaaaagatttcaggagctgctgatccttggcacatctaatagtaaagtagaggggtcgtcatctaaccttagatgtggacaggcatcgatgtactgcacctccaagccacaagtctgaacaatgggcagttataaattgtaaatcaggtctgggtgtggaaacaggaaaatctagggctgggattgtttgtccaactctgattgacagtaggttggactgatcagaaaatcataatggtgttcaaatgtgtgtttgagttttgtgtgtgtgtgtgtgtgtgagcatgtctctctgttgtatacactatgtacaagggaatccagccaaactatcataaccctgatgtgtacacatcatttcagcttgcatatatgctcttagccctttgcctggctcacacccttaggtaccttgttggagatgttcttgtacctgttggatgggaagaataagaattgtaattaataacctcaattcagatcaaagactgcagacttccataaattaatataaaagtttcatttttcagccaagactgctaagaccctttgtttgaagaggtggatgtccttctctctcccctttggttgagcacgacactatgtaggaccccaatgatagaatgaaggcaagcctgatactttgtatatttgacctattaatagaaaaataccgtgtgatgatgagcccttaataaacattaaataagaacaagagttctagcttgatctgtgggctgattgattttgtagagtttcttaattgacttcattttttaataaaatagaatatgcctgagagagtggaagaaagaaaaataagctaattggaatagaggtattgcatcattgatttgaatttattttttgctatgctttctacattgattaattgttctatttgaaatttttagttgaatggttcacaggcaaactaagatgtataatatttatatgtagctgccactgtggctcacctgatatatcattgtcattctatttaaggatccttagacttaaaattctttacaatacttgcatattccccacatgctcacacattgcatgtcatgtttttccttaatagagttgcttttgcaaataaatacatctttaaggaggacatggatattagtttcattctttaaagagaacagcaacaatacttttttattttaaagagaacagcaacaatgcttttaaattatcaaagaaattttacatttattaacttatttgaatcctacaacaacactgagatgagatggtattatctctatttgatagacaagaatgctgagccccagaagatgcgagcaatttgttcagtatcacatagactgtgagtgctagagctaagactgaaacccaagtctcctgcctcatcaaaggtggtgagcccaccttaaataaatgtgtgcagaacctgggcctgttgacagcatcaagaaatacatgaaaccaacgtgaagtttatatcgactgatactacaggacataaagcctgaatgaactaaaaatgagatatggtttaaatccatttttaacaaaatgacatatatcacaagcttctagaagtaattagagattttaactttagaaactctgggcagtataaactggtgttaatgatcacaacagaggcaaatcagtgtatttgttgactttgtaaaatgcatataaatacttatgaaagagtgttcagataaattaaagctagtgagaacatctaacgtctttttcaataattttctaaaagcaaacaagaaaaggtgtgtgtgtgtgtgtgtgtgtgtgtgtgtgtgtgtgtgtgtacgtgcgcaccaccatcttaccatcatccaaatggggggtttaaatagtctatcaagttaatgtctctgaaaaagcctcatgggtggatggatgaatgattccctatggattatcaagaaaggtatatcttttataaagctatttctagcatgcactgtagcatttccagatattatcttggctgaaattttgagaatttgtaacagtttgtgaagcaatgggaaagaggaatcttgtttaatgaaaaaatgtatataagcagtaaggagacaacccttagatattttgtggtcaattcttttaagtccatgggaaatttggatatgttaaataaattttttatataaagtgtgtctgtcaaacaaggtagattcatgtcttaatctcaacatgcaagaaatttcaaacaataaaattaccagagaaatgagtctctaagttaccaagagaacaaaatgaaatatgaaaaatgtttaaaacactctttaaaaatgtacatatcagattaatcatttcaaccaatagtcttcaaaatgtgacaactatttaactgaactgataaataattttattgtttctttgactttacacaacaaaatattattttcaataatataatacactaaggttgaaaatacaagcagcatggatgattccttgatattataaaatattctggattatagtgatacaaatatccagaaggggacatttgatttagatactttgtttgattcatttatttttatctatttatatttattgtttttttagagactgggtctcgctctgtcacccaggttggagtacagtggcacaatcatagctcactgtagccttgaacacatgtgctcaagtgatcctcctgcctcagactcccaaagtgctgggattactgtcatgaaccaccatgcctgactcaatttaggtagaaggaaaagagctaaaacctataatcacacaaaatataaattctgcgcatattatatttacttgacattagctttttttttttttttttttttagacagagtctcgctctgtcacccaggctggagtgtgcagtggcacaatcttggctcactgcaaactccacctcccaggttcaagggattctcctgccttggcctcccaagtagctgggactacgggcacgagccgccacgcctgactaattttttgtatttttagtagagatggagcttcaccatgttggccaagctggtctcaaactcctggcctcaagttatccacccgcctcggcctcccaaagtgctgggatacagacgtaagccaccgtgcctggcaacattagttttttaaatatgttaacatcatatattaaataaagaaaacatattgtaatatttaaataataaaagaaattaggttttcatttttctatgctaggttataaaagctatttctttattgttttattgatttttcaggttattagtgtaattttttcttcattaaaggatgtaacggtaatctaggttcatgatgtaaaatttagatttcacattaccaaaataattaattgaaaaattggccgttcagattgtctacatcagtgaatttgaatttaggaaacagtatctttaaaaaaaagcatattggaaaactgacataaggttgacatctttaaattttaatatgtaaggacactaaggatatttaaatagcaaaaaatgcaaggaaaatgtatattttttacatttcctacatattgtcaacacagtaacacagtattagactttttaattttttcaaaattagtttgaaccttttattcttgatttgcctccaatagaatattgtcttggtaacttcatttaatactttatcagctagtgtgttctaagcctttgattaatcagaaaaacataatgaatccatcacctttttacattttgattctaaaatgatgtaccttctgtgtttcatggaaatgggaggtggtgggcagaggaggtagaagggaaaggataggaacaaatccccaagcagggaatgttcctaagtccttgtcttattctaattggatcatctgggttcagttgcccacatgtggagcagtagcatgaaaataggtaattgaccacatcaacaagacatatttctctaagattatggaatgtcgagaagagaagggactgaggcttaaactaacctagtccaccactgtccatcttttacatttgaagaaacatgtgtcatgaggggttaaattacttaacacaactagtttactgcccaaactataactacaaactatatcctccatatctgctgacaattactttacattttacacattgtggccatcttttaaccatcagtagccccaacttccaggttatagccttgaaccaaaagtttggaaattacatttaaaaaacatttgtgaataagtggaatattcaaatattggcacaagagagatgacttcagaaaacaaacattctttcactttcaatttggatacatttacacacacacacacacacaaacacacacacacacacactgatggcttgctcactgatttctatctctaaactttaatgtgggtttggaggcatgtcttgggaagagttcttaaagatcaaatagaataataatctaaaaagacttagttctgtttatgattttgctaattatttaaatgtctgaagtctatcatggacaaacttatgtccctctcacagcttattatccatctacaggtttaaaaatatgcaatatgtgagtctataacttgaatgctgctagtactggctcataacagcaacgttgctaagggattacaccaaatagcactgtattatatttcaaaagatgtggctatttttatcctgaggaacattttatctacgtttaaaaataagaaaactgatttttcccgaagaataagccactttaccttattgtttaaaacttatcagctaaattggttggaccctatattcacacataccaccattgccccaaacctcaccataccactttggagattgagaactctataaaatttgctttgtcatctaaatgagcatttataattcttgctccgtctcaacgtggggcatcacatccatccagttgtctctggtctgtggcattcttagactcttcctctcccctaactttggatctcaaagaccaccaagatcttttgaatcgtcctcagaaataactcttgtgttttttccttgccacttccctagttccagcacttatcctctattcactaaactatcgcaatagcctctaagtgatctctagctccaacctctcctcattcctgttgttcctttttttttttcaccccaggctaccagtttcaccaccatcttctaaatcttaaggtaatttctctttgccttcaagataaagtctaaatttcttagtttgactcttcagaatgttggcccagtcggtctttcttgcagaaagtctaacttttgtccccttttgtaaaccccatgaaataatcacacttaaattctggccgtggtctgagttctctgtgccttttcacacctctctttcttgctgaggctgcttcttccttctagattgctttccctatgctctgcaacaccccttccttacctgttcagaaaactcatgaatatcttttcaaactcagttcatgttaccctcttgcggatattcctacacaaagaaggaatatttttcttttctttatttttttatttttttatttttattttttatttttatttatcgtccgagctggagtggaatggcgcgatctcggctcactgcaagctccgcctaccgggttcaagcgattctcctgcctcagcctcccgagtagctgggactacaggcgcctgccaccatgtccggctaatttttcgtatttttagtagagacggggtttcactgtgttggccaggctggtctgaaacgcttgacctcgtcatccatctgcctcgatctcccaaagtgggaatatttttcttttctgggctttcccatagctttcgtatattatttgtactctagcagttatcaattgcagtttaattatttgttttatgtgtttcccccattaggtatgttaggaccttgcacagtgaatggttttatatagatttttaataagtggtgagcttttaaatgtggaaataataatgaaaccttgtctttttagtttgtgctctctcagacaggatatatttgattttcttaataatctctttgaaacacacagagttagtgattattttacccattttatagatgatggaagggaatattgaatctcagaaaaatagacacatattcatgttcaaagatagaacttggacttgagccaaaaaggtctagtgatcttttttattgtaatgtaatgaaacaagagatactgtgagtataggttggtatgaggagaagcagcctataatttgagttaagattatgaagacagagtgaaattataatattatgaagagaaataacagttttgatctaacttatgaaaaaaaaacaacatgtaagagtgaaaataactctgatgggataaagccccctttgtaaatttagagaagtgcctctacagagtaaattcttaaccttgggttatgtggctctacaagattcattacatttggaggtaggcacacatttcttagagaatgtttatccaattctcaatgagtcttttatccacaaaatttaaggcactgtgttctaaagctaagttattgactgcttcactaagggaaaaattatgagaacatagtatactaatggagtaagattatcgttggggtggctgaaagtaagcagtttgaaatgggattttagaaaaatgcaacacttcagacagataaggtcagaggcttatttaaaaatgacaatccccagtgggattttaggggattacttgacttaaaatttaatttaaatataaggatagtaaagaacattttgaaaaaataaaaagactgtttttccttataagatagcagaacatatcatataggctattaattcaaacagcatgataataatttagaaataaaccaattattcaaccaactggataaatggtcaagaataaggcccatgcatatattgaaaatttagggtttagtaaaggtagcagtccaaatcagtgagaaaaggataaattatttaatataggataaattgtttaatggtttatggaaataaaaaatgatcattacttcattcatactataataaagagcactggataaaaaagattaaaaactcaagagaaaaacagataaaggccatgaacagaaaattcaaaaaggaagaaaaatgtatgacaaatatacatttgaaaagtttttctacctgacagacaaagaaataaaaactgaaacaatttttcatctatcattttggaaaaagatgaaaaatttaaaagaatttgagatggtatacagacatagccactttcttatgtacattttcagtgaacaatatatcaggaaatcaggaagtataaatcaggaaaacattggtgggtgatcaaataatatatatcaatattttaatgtgcatacttttgtcccattaattctatgtttagaaacttagcctaagaatataattgaataagtgagcaaagaaatactatattgcaatattacatataatagtatacatctggaaaccacccaaatatctttcaggacagaaattgtaaaataaatgatgatatatctgtattgagatctgtatgtattgaaattattgaaatgttattttaaactctacaagttgttatgtggaaaaagcaatttagagaatagatgacagaatatggtatcatttaccagtgtgttttcatgcatgcttatatttacatatatgagattatgtctatgtacatgtgtgcctatagttatgtatgtaggtgtatgtgtggtatgtgtgtgtatatatatatgtgtgtgtgtatttatatctatatacatatatatgtagagtgagagagagacagagacagagacagtactacatatatatgtagagagagagagacaaagacagagagagagaatacatatatattctgtctaagcaggaaaaaccaccaaactgttacaggtgtgtgaagagaggatattttgagaggtctttgattttgttttatgttctcttctcttactcaatttcctttaaaatgagcatgtgttgtttttataataagcaaaaatcatgtattttctccttttgtaaaacaatattttcaacttatttcgtttaatatatttcacttgtatttcacttgtttcttacccccccaaaaaaagcaaaggattgcgtttcataaaaaaatttagtaaaagataaacatgaggacatcaaagagaagagaaaatggcatgaaaatagtatgaactatgaaagcaaaaattcatttcattaattcctgagtaattgctagaaacgagtcacagactggttctgatcttcctatcaactaatccaaggaagggaacactgttgctttaagattcatatatcggtaagttaaaaaatgagttgcttggtaaaatatattgctattaactctgagaattaaaagaaatatttctctgtggtgttttataaaaaagatgctatgtgatatggtgtgtgcagtttcaacattttttctatacttcataaagtttgaaatagatataaatgtttcttataactgtgactgattcttataaaactacacattgatggcctgttgtctaagttccattcattgaaaatctatcagcactggagccccagttagcattcttaacagggcattctctttaagactgaacactaagtgtgcaccattaaaagaagctgcattcttcaacttggaaaattcttctagactcactctcctgtatcccacgttcagcctcttgttctcacctgaatacccgaatttgatttggatgctgtatgtgttctctggtccttaagattaaaaactaaggtcttattttagtttcttgctcaaatattgcttttttgacctgctctgttcctgtaactgtagccctcaagcaagcccaacctaattctcaagtgtggctcagaattctgggacaccagcccaaattgggtcttccttatttgtgatagaatggaaccaaaggaataagagaggctgggcatcttggctcacgcctgtaatcccaacactttgggaggccaagacgggcagatcacttgaggccaggaattcaagattagcctggccaacatggcgaaaccctgtctctaccaaaaaatacaaaatttatccaggcatggtgacacgtgcctgtaatcccagctactcaagaggctgagacacgagaattgcttgaccctgggaggcagagattgcagtgagccaagatcgcgccactgaactccatcatgagcaacagagtgatcctctggtattttttcttaaaaaaaaaaaaaaaaagaaggaaaggagaattcagtgttggtatccagctttctgattttctgacatgaacaccccattgtctcgatatttataacatatccacttccagttgaatgcaccaagataatctagttgcaaaatgtagccccattaaatacatggattgacacatttaaatataagccagttaaatgttagaagttacttaccaaaaatgaggttgatgttttagaataatttactcacagcccttctctctgaaagcaattagagtaatacatttttagtctatcgagattgtccaaattcatgataacaatattacctagtatgcaggtgtgcttccagctcacttggaagcatttttaaatcattaaaacataaagtaaaagtttggactcttctatacacacatttttattttactaccactcaatcattcccaccacctgggttttcagttttattgaggaccagtttcttgtctaatgatcagtaggcaggggtctctactgtccagaaatcatgtggttactcatcacggcagctgctactacagacactgaagaaagatcatccaacatggataaataccctgttcttatcagatgtttgagaagtaatagagtataatgatgcccctcatgtagaatatggttctaagaaacccatacttatattaactcagaaactgccataaatagctgaaatatccaaataaatcaacagacccacagtttgtgagaaacagaaggatgttcatggcttcaatgggataggccaaactttgtgttgaattatgtgcttctttatgtcttgtttcctctgcctgaaatgccttttcctccacacccattagtgttttataacacctactcatacttcagatcttgattcaagcatcacttcttttggtgaagtattttcagatctcccaaacctgtcataataccatatagtgctcctttatattgtttattatattttcaattacatgtttaattgtataattattgataaggccaatttctttcaccaaactataaactcctatgaaaataatgactctgtcaatttttctcacattcaaacacagtatttgtacattgcttgaactgaaagaattattaataaataattgaactccagggttaccaattttatgaagttaggaatatactgttaaaagtaagtagaaaacaactccaaattcagacaacctttaccatgtgctttattttattaaagagttaaaaaataactatacaatttattttatgtaaaagacacttcagtttacaaatgcaaatatcacctctggaaataaacctaaaggacaggaagtcattgaagaagtggcaccatggattgccaggatgatgatgttgcaggagagttatatttaaggagacggcaaataaaaaaatgataataaggacattagatactaatttcaatgttattttgtgttttgtcttatgattattttagtgtttatgcattatttaacatttattaataaattataaatactctggctcaattcattctgttagcttggtttaaacatatataaaatgcccacagctactcctgttattggcatctggtagttctgcatgacattaagacccaaaagtaaaaataaataaatttcttgactgagaaaataattgccaattcaaaatggtctactaaccttaacattcataagaagaagagtatgtatcatcatcctggcaaaatggcacttataatttcataaatgctcctttttaactttatgtattatttttattttgggggtagtaagatgtggaagctgttagatagtcattacttctgttgacatggaatattttataaacatgaaatatttcacaaaaaataaaaaaccagtaataacaggtcacatacacactcaataatctcactatagcaatatttcagaaaaaaatgtatttagggaaaacaatttatgtctgtttgtttttagtggcagtcatgacatgaggaccccagactcaagtgcattgccatttactccctggtagaatgtgatttcatttccaatgagctcaaacataatgattatatgtcttactaattatacaaaacatggtgaagaggtagtgtgctttgtgatgtcacatatcaaaaatgctttcttttaaacatttctatctccttagctaggtttaagagataacaagatgggccactgaagtaactttgtcaagcatgttcaatgtaatatttccccagagattgttttaactgattcgaccaaattagattattgacttgacaataatgaacaagatacccctttgaatttttgtcactacatctttttgtaactcatgaaaaatttcaggccaggcacagtggctcacacctgtaatcgccgtactttaggaggccgaggcgggattattacttgagctcaggatctccagaccagcctggacaacagaccaaaaccctgtctctacaaaaaatacaataattagctgggtgtggtggcgtgcacctctgattggtcccacctactcaggaggctggggtaggaggatcgcttgagcccaggggttcaaggttacagtgagctatgctcctgctgtgctgcgcaatccagcctgggcaaaagagtgagacctgtctcaaagaaaaaaaaaatcagaaatgtttgaacccataaagtagataatgaggacatagtgggagtatgtagaaaagcaataacaggccaggagcagtggctcacgcttgcaatgccagcactttgggaggccaaagctggtggatcacaaggttaggagtttgagaccagcctgaccaacatggtgaaaccctgtctctactaaaaatacaaaaattagctggacgtggtggtgtgcacctgtaatcccagctactcaggagactgaggcaggagaatcgcttaaacccggggagcggaggttgcagtgggcagagattgcgccactgcactccagcctgggtgacagagcgagactttcgtctcaaaaaacaacaaaaaaacccaaaaacaataacatatagcagtgttggccctcaagcagtctggcagcctttttattgctttggatgccgtttgtgtctaagcatttgctttaaatatttgatgtagttaattaatgagtattttggatcttctattatacaaatctgcctatgaaaaataaatgcaaacaaattacaaatttcaaatgatagaagaccaaacggaaatacaacgataatgtcctcaaatgtgcactagtagtttaacagaatataactgccatctgattattaaacagtagaaattgtttaagtagatagttaaaaactgtagtatctaatggttagtattttccaagacagtagcctaagagagtagttcaatatatacggagttccggctgtggaggatggggctggtaaggaaaagcaagaagaggaaataaggctttgctaaagattccttaacttccctataagatgttacagaggcactgattggttttaagcagggaaattatgtggatagttttgaattttttaaaacttactttggtagggccgggcgcggtggctcacgcctgtaatcccagcactttgggaggccgaggagagcggatcacgaggtcaggagatcgagaccatcctggctaacatggtgaaaccccgtctctactaaaaacacacacaaaattagccgggcgtggtggcaggcacctgtaatcccagctatttgggaggctgaggcaggagaatggcgtgaacccaggaggcggagcttgcagtgagccgagatcgcgtcactgcattccagcctgggcgacagagcgagactctgtctcaaaaaaaaaaaaaaaaaaaaaaaaaaaaacttacttcggtagatatgtagaccatggagtgggaagaaattaaaggtgtgatttaggtgtttattgcagtaaaccagatgagaaataaatggtgatagtctgaaactgatgctgtggcagtaaaggatggacatggcagtaaagagatgaatttaagagaggttttttttaaaagtggaaatgatagatcctgtcgactgactgacttaatgctattagataaaataatttttaaattacatgtatttccaaaaagtacaattaatgaatccatggccaggcatggttgctcatacctgtaatctcagcactttgggaggccgaggtgggcgaattgcttgagcccaggagttcaagactagcctgggcaatatagcaacatcccacctgtatttgaaaaaatagtaagtaagtaaataaataaaaatccataagtatttggacacctaaggtaaatttaaaatcttgcagttttgttttcctttgttctttgtaatttttagcttgtttgagtgggggaaagtttgaaatattgggtaaggcaaacatttgaaaacgctcatctgcagaggaaatttgcagtgttgtggatagatcacttgtgtcaatatgtgaagcataacaaatgctttttgattgtgaaagcataggtagatatattgcatttcaggtcaccactaattaattgcattaatttagttaaattggttttctcaactcatctgaaaaagatgaaaactaacacttcaaactacttcctacttggtaacatcataaagacaaatgaactttctttttcagtcatttccctccttcccctgttctgccctctctctctaactaggaagctactacaccagcctttccagctttggttttctaatcttaattatttctgtacccatctatcactggaaattcttcaaacactgatgtgtggatgtttgtgtgtcgggggttgaggggtgagtttggggagtggtgctgtgtgttattgcaaaattatcctttttttgctttatctttaaaaccttttggaaacttgtctaaacttttctttctcttttttttggcagaatcttgctttgtcactcaggctggagtgcagtggcgcgatcttggctcactgcaacctccttgtcccgggcttagctgatcctcccacctcagcctcccaagtagctaggaccagagttgtgtgccaccaatgcccagctaatttttgtatttttttgtggagatgaagtttccggagatgaggtttcacgtgttgcccaggctgctcttgaactcctgggctcaagctccgcctcccaaagtgctgggattacaggagtgacccaccatgccctgcaaacttatctaagctttttttttgttcttcttctttttttttttttttttttttaggttctggcatacatgtgctgaatgtgtaggtttgttacatagatatacatgtgccatggtggattgctgcacttatgaacatgtatgtttattgtttaagcttttttatcctttttatcaattgtatgtttttaaaaatctctgccatgtgcttttgcctctggctaattctatctgcatagacaccataataatctgttaatcacacttaacaagcctttgcatttgatatacctcttacaaacaaccaaacgaacatgcaggcaaaacaaaacagcaacaacaataaacacttcatagtctttcttttgcttgtttctctaggatgactattcttaagacccacacctgacaagaataattctttaatttttcattttcttagaatcaaggtattgtgttttcatgtagagttgtaaatatggtataagcaaagatacttgctctcaaaccaggattttatatatattttcatattttgtggttctatgtatgcatttttggctctaaatatttgttttcataataccattaatgtgtaggacaattactatgtatttttgttgttgttgtcctatccttttcctttcccttcatcttagtattaggataagtatgcaacagtaattttccctttctatgagataaaaacttctacatcttcctaagataatattactgagatagccatttatagatcattatttaaaaagactttttcatagtgcattgacatacactatcccaattgttcctcatatagaagagttttaagttgaagagaaacataatcaatgtcctctagaaagattcctcttgtagtagcatagaaggggaataaaaataaagcaagacagaaggtggggggagtccagttgagacattatgataaaaatccagtatagcagatagagtcataacttagagcagtggaataaataggttgatattattaggctaggtttgtccattcttagcaatcaattagaaaaaggcaggtggataaagaataaagagatggaaatcttaaggtatgtactcagccaactgggtgagtgatggtagcacttaccaggtcaggggaggaaagctgaagagtttgctagtgaacacacaaatagaaatgttcagtagattattgtcatcatcatcatcaccatcactatcatcatcattatcatatttcctcagcactatcatttattaatttgtgaggcttggtactcctagaagctttgcacagatcacagttcacttaatcttttcaacagaccgtggaaaatatacccttttctctagatgcagacctggaaaatggaacttagaaaagttatagaatatatatgttgttgttgtccttttaagctcagtgtacatgtgcaggatatgcaggtttgttacataggcaaacatgtgtcatgggggcttgttgtagcgattatttcatcacccaggtattaagcctagcatctattagttatttttcttgatcctctccctcctcccaccctccagcctccaataggccccagtgtgtgccattcccctctatgtgcccatgtgttctcatcatttagctcccacctctaagtgagaacatgtggtatctgtttttctgtttctgtattaatttgctaaggataatggcctccagctccattcatgtccctgcataagacatgatcttgttctttttttatggctaatgctagaatttttatgactccaaagttcaggttctttcaatatatcagattttaggaactcagaagaattgagagaatagtgtggattggttggaagttactaggaaaatatgatgagcatcagaaagaacacctaaataagggatgccagtggggaaaagctcaaggatggaagccagaggtgcaccatttaaagtgcaaggaggaaaagaggagtcagtgatgggacctaaggaggaattctcactctgtcctttttcaagcaggatacagattccttcttttttttttttttttttttttttttttttgagacggaggtctcacttggtcacgaggctggagtgcagtggcgcaatctcggctcactgcaacctctgtctcctgggttcaagagattctcctgcctcagcctcccgagtagctgggactacaggcgagtgccatcacgtccagctaatttttgttatttctagtagagatgggatttcaccatgttggccaggatggtatcaatctcttgacctcgtgatccgcccgcctcggcctcccaaagtgctgggattacaggcatgagccaccatgcccagccacagattccttcttgtgttcatttgaaatgtgaactctgaacaaaggacagtttatcttggatagtcttattccatgatttatatatcactaaaagagcagagaatctgtagatattataagtgggatccttaataattaatatatggaaagagaagcttaccagataccaggatttttctgcattgcctggaaaaggaggatatctgcaaacttttgtaccctgtgcacttatcagattggacctcagatgggacctctgccccacagaatttctctttaatgactcattgcttactggtctaagaagaaaaataattatagcctcaggttagaaaaattgaaattgaatcatttcacagtcagattaatgctccattagtcccatctatatgaaagggaggagggagtcaccaagtcaggttggaaattccttgggatgattgaatgtaagggagaaaaactgtgataattgacatagtcaaggcaagaacccagttccgaagcaaatattttctttgtgtgaggaaagggtacagtattgctggttcttttttacatataatattactttgtattctcccaatactttatttttttttaaaatggataagaaatcataaccagtagagagagtaaagaaacacaggtctattttctttaatgaatatcatcactcttgagttataactctattatctacagtcttgttaagtgaaaattgtttcctcaataagaacacttttttatagaagttgaagttctcttctggcacacattagaattctccagtattcatatttcagttttattcatggtgtcaaaaggaattgatgtgataaaatttccaataatgcaatgagaatattcacgtttgtgcaaataccatggagatgttgagaagtagagtgaagggacattatgtgaaaagtaacatctcactggactcaccaactctaaatcttacttttttcttcagagatgaggtctcactctgtcactcaggctggggtgcagtggcatgattatggctcactgctactttgaattccagggctcaaaggatcctactgcctcagcctcctgcgtagggagccatcatactcggccatttttttaaaaaaaaatttttctgtagagacaaggtatcaccatgttacccagactgatcttgaacccctggctcaagcagtcctcccacctcagtctctcacagtgctgagattacaggtgtgagccaccatgcctagcttaaatcttgcttcttatatatgcaattattaacaatagaaagctgttttgtattactagattacttggtttttcaaaatttcaacaactctttttgatttttaagaatattggttagaatggaagtattggcataagtcactagttttcaaaaacatacccagcagagttgaaagcgaatgtaaaacgccatggcctgttgattctatcatcgtatagagtatttttctgcttatgtacttttattgttttggtttagagacatgtatgatttattacaccagtattttaaagcacattctccctcttcatttctgcaatgtactgtgtcgaaccaacttcataggtaaaagttgtaaaatattgctaatttcacatggttcagcctaatagaatctcatgcccttttaagccttggagaaggaaagcctctcatattgtctccttccagattcttggctcaatccaagcttctgcatagttggagtggcaaatcccactcctgcatctggtgagctgtgcagttagcagctctgacacttttctacgctgttcaaacaattacagccccaaaatgtgagtgtggccttaaaaaaggctgattccatgtgactaccagattgcttcaagatctgcccagtcatccccctgactgtgtcatcccttaaaaatctgtgtcatctgggtacagaaaattagaagaatgttctcttgatctctgcttaaattttcagaatttttcctttgaaaccacgaactagagaattggaattagacttaatgacttgactctatgtagtatatatttcttttctccaaacactgttttgtatacatgaggagggacaagaaatgaaggaaggggaaaagtatagcgtttcagccccagaaaggtacctttcacaatgtaaatgcagagtatctggttagacatagccattttgcgcacaagcacattcagagatgaagacatgcagtctctaattgtttcgttgtatctaagagggtgaaaatagaggtggcatatgaaaaaaaccttccattttcattgagcgtacccatattctatggcatttcttaccagtcagtaggagttttttttcctactgatcagtactactgaattacccaaaggcaaaaatattccctattgtttctttgttttctaactttgttctctagcttctaggtagatgttaactttttggtatttaaatgtgcacactccctgagaccaaactgcctcagcaagttttacttcaatattaatgggcaagatgaatattgtttgatgtttcactgttagcaaaagggaggagaaagaactagaactaagttcaattgaaccattactatgcagggtctatacagtcatgattattatctcagattccaaattctgtttaccaaaaattatgattatcaaattgttaagatagtaaattttatgtgtatttttaccacaataaaaagttggaaaaaatgatttgactatatccaagtttgcagagttggtaagtagctttttattgcaaaaaacttgctgatttgtgaaagaaccttcatttccaaattaggaataatttcctgcaaggaaagactatgctgtgtgtgtgcctgtgtgctcttgtgtgtgtgtgtgtgtgtgtgtgtgtgtgtgtgtgtgtaactcttctgttgtgaatccatcagtggttttgcattgtttacaggataatgctcagaatccataacaaggtcagtaaactcatctatcatttcctaggcatgtctgttatctgatctctagcctttcttctcccatcgtcgccaagtttagttctacttgacttccttcacttccttcccattgacctagggagcacctctaagactgaaagggaagtcgtgggcttggtggagttgaggtggggaatctatgaacagataaatcagatagaagcattgtttggtagaaagaagagctcatgagtggcagtagagattgagttaaagagtgggatgaaaaagaatcaaaaggaagtagtacgatttggtgaccaatttgttagaagggatgaggggcagtaagtagtcagtgatgaccccgaggtttctagctggacctagaattgtccaactagtccaaaaatgaaaaaatttgcctttaactaagatgagtttgacaaaagatgaagtaaatttgagggtgtaggtaatgaaaacaagttggctttttctcccttgatggcaaatttcagtgtgtatggatgtatacatttgtgtatttgtgtgtttgtcaatacccattgatttttcttaggttatattcaaatactgaagttgtactaattaagcaaccgaagtgtatgctttcagcatggtacctttcacacagcaccaaacatcattatattattttctattgtagcataacaaatcacaacaaaattagcatcttaaaacaatacacatttgttactttacagtttccatgggtcaggagactgcacttgacttagctgggttttctgttcagggtctcaaaaggctttaagaaaggtgttggccaggattggggtctcatttgaggttctggctcctttttccatatcaggtggctgttggcagaatcaatttcttaaccactgtaaaattccttgaagcttgtttcttcaaggtcagcaggagaaagaaactctgacttctgacttctaggccattttttggagagctaatcacttgcttagaccagaccaaccctgaataacctttgattaacttaaagtcaactgattaaggatgctaattacatttgaacaatcctttaactttgccatattccactggttaaaagaaaattacagatgttgaccatctgggaggagatagtgtaagggcctgagctattggagatcatcttagaattctgcccaccacaatcgtgttctatgtttatgcaggtatatgtgtgagtgtgtatttatgtgtgtagttaataacttaaaaaatgaattacatgtatcccaaaacaagcggcaactgcacatcccatgccttcttacttggattagtttttcctgaagttactccagggtcctgtcttcccattgttaggtttcctttctgctgtcctggcttcacctttcgtagccaagaaagcactaaatttggctctgaaatgtacatttcagtacaatctccctgtcttggcagcagtggtgaggctttagcaaatcgtttgtgatcccaaatgagcttcagcagtttggagtgaggccatggcccacatgtttgatgccaccagcctgatttttgtaatgaaaactatatcaataaggtaagtagtcccttcttaggcatgcattcttttccaattttatgtagtggtcagtcattcttacagtgatacaaataaatatttatgctttcatgtcttttaagcttttagcaacgttaaaagaaaaggagtctgtaatgaatgaaattgtcccattgaacttattttttcagcttttgaggatatatcgagtgtacttcttaaaactgaacatgtgcatttgttacatttatatatgtttccacatatcactttgtaaaagaattagagagagcttatgaaatagaatttaagttgatttggtatgagcaaaatatattgttggaatgaagcaaaggaaagaaagcataagagccatcatagttaattctgtttaacttgttttaactctatcaaggttgggccaatgtggcaatttattaaataatttgctctcattaatgcaaaagaagaaatgttccttagggaaaaacatgttgtcttgggtacaaaattccagcaatgttttttaccacatgagactttatggaaaattccagataacagaccttgccctaatggtatgtgggcaacaaatccagaagtatctatcatagcattctttcttataacaaattttattagaagccaaggctagaatgttgaagctggactccgggcaggtgattcaaatgccatactattactttcctagcatggacagttctggttattaactcactcttacataaaacttttagaaccagaggattggagggatgctgacattccttagatatcttaggtaataatcctgaaaattcacttttcctgaagtttttgatagcagatagtaagaaaatttcactttaaaactcactttgaggacctgaaatgttatattccactttgctgattgaggtcaaggactattgtttgaacctcaaacaagcaggtggtgaggttcactttcaactggtaattacgagaaaacgaaccattatgctagatgcaaggccacctcatcttgcatccggtaaacatgccaacaaaaacacaaacaagtgtctgtaatacctttcaacagctccctgttgctctcattataaatatggaaatccttaccatggcattcaggaatctgcatgatctgatgcatgtgtatattgacagcacatcttgtatcattcgtgacatcactctctattatttggctgattttgacctaattcagcacttggaaaccaccatactcactcctgccttggagtttttatgcatactgtttcctctacactgaataatacctccaaaccctaccgtcactgcctattaaccccctacttctcctgtttctcagttcaaatctccctttttctgattatgtgtctctgattctccaaatcttgccagttggccctgttagggactctcagagcttactgtagttttatttcatccatagcagcttatgagatttttttcattaatgtctattagccagatcgtcagctccatgaaggcaggttgcaggcttgtttttctgaccactctatcatcaacccagagcacaataaatgaacataaagtgaattcaataaaaatgtgctgaaaggataaactactgttatttactacattaattacaacttttgttagccccttacaaaagatgctttcttagatgctgcatttcccattctacagaggttgaataatatgactatgatagttttagaggagatgggaaatagtttggtatttcttaaattaaaatatgaatctgttagagctagaattttattttctgaaagataatcttgtttagccagtgtgagaaactacattacacaaagaacattttgctagtattatttcgcaggagaactaaacttggtaaactgtcgttcctagaagattgtttttatcaggcaccgttgccttctttgagctttatgaactcatgttttaggacagttagacattactgatggagttagagaatactagaaagtgaacttcagctaaagaaagtgatcttttttctctaatggcaattcagttgcaaagttctatttttattctaaggggctcatagagggtggtccccaggattctcttaggggtctgtgagaccatacatattttcataataacaccaacatgtcatttgtaattttcactgtacattttctcagcagagttctccagaagctatacaatgtgatgcatattatttcataacagattgaatacggaagcagacatgagaacctagatgtcttccattaggtggcacaaataaaaaacattgtcactcttctcacagttttttggaaaatagttatttttaccgaaaataaatttattatattttttgaaaatgaattagtaaataaatatttataattgtctcagttttaagatggcaaatattccacataaacaagaaatctgtgagtcttcaataatttttaagactataaagagattctgatacccagatatttgagaatcacttctccgagccattttattgacacaattttacttgactttgcaacctgaccgttttagataccttttctttccagtcttttctaaaagatcaattgattaattgggttgactcgatgatacaagcacacgatcttcagtatcaaaagatactcatgaccagtaaacccctctttagttctcaattatccaattccctttcctggaggcaactgctactcttgtatttcctaatggagatcttttatgtgtttactcaaatgctaagacataatatatcatattctgcttcctgcttatcttccctaatgatatagcaaggagattgattcctaactctgcatgcaaatctgccatagtgcttttagcaattgcagtatcgtccatgatctggatgagacataatttcaccagactcctgttggagtctgttggattgtttcccatcctttgtcactacctacagtgtagtgatgactattcttttacttatttgttcatgtaaagtaaatatatctctagaattaatatttggaggtggaattcccaagtcaaaggaaggaaatacatattttttaaaaggattttagtagattgttctgaaaaaaattacaccaaacttaccctcacatgactatttttgctttttctcagtatactttttaatagattgcattataaaattttaatatttaccatttaaataagtgaaagcaatgtctaattgcagttttaattttatttttattaaggaagttaatcttttttttttagctgaagtcgaaaaatatgttcatctctttttcattgaagctcattagtttccaaaaatgtgtcctcatttcatacaaagtatctttgaaccattgccaggtcatagaagtgactcttgaagatcttcttctctgggatcaagggtcacatctcgttctcctggcttcatacccttctctctctacacatctcaattaagtaagcttcctttcttatcctctgaaattataatcatctttaggctcccagatataggtgacctgtgccatctagtctgacttccagtttgcaaattatcttcaaaaagtggaaacagcttttactttctactttataaattcatacgtgctcaggaggacttttattaagattgggacatattgcttagttagtctctagggtggaatcataattaatgaaagaactctgtctgatggaaggcttagtctaacaaatcatcctaaaacttcattagacattgtgtaatccccatggacactgttgaagagacacttgattaggcagatcgtgacaacttcagctttgcccatcatacatcctccagagactcctcaaactcaagacagactttctacaggaaggaatggctgtttctatttcagaatattactgataccagagctttgctgcatcttcatgtactttcctttatttttatttttatttttttacagacaaaatcttgctctgttgcccaggctggagtgcagtggcatcatcatagttcactgtcacctcaaactcctgggctcaagtgatcctcctgccccagccttccggagtgctaggattacaggagtgagccaccacacccagtcttcatgtactttcttatgtaaatttattttgtttgagattttctttgtgatggaataagcaattccttccttaactcatttcccgagacatttttggaatttgcaatatatatgaaaaagcacttattctcagtgatggaaacaccattatttcttttactagaatgtgatcttctggttttaatatttatgtctctgtgccaaggtgaaaatattgtagaaatgaaagtataatgagagagaatccagataataagattttcaataaacaaaaaaagaagtatgtataggagtcctgtctgctgcaaattttaagaatggttttctgtcaacatacagttgtcattgcttactgaaaacttctataaaaaacaagacacaaatgattgagaagatagtagagactgaaactagaactgttgatttaataagctttcttactcatatacttaatccacagtaaattattagcaaattacattttcatagtatttcagaattaaaagatcatagtcagggcttaaaggaatccagttgttttaacagtgctggaggcaaagcgttctagcagcaatcacctgtcagaatgacttaggttggattgtttgcaccacacactttactatagttacatgtctttcatgtccctttgtatctctgactcagtttcctcatcagtggtaatagcagaacttacattttagtgggaggattaaaataatgtacatgaaatcaaatatataagtcagcactcaataaataatagtttgtcatcattattactatagtaaatgaccactatctgaaatgggatataaaaaggaaagtgaaattactaaataaatatgagcgtacaaagacctgacaatttagatacaatatactcactctgtctcaaaatagtgtcttctgaagctttagtcagaatattatggtgacatttctgctagatttgtcattgagttgctgggtttggggaagaacctaggctacacatttctcttggctctacaaaaggctgtggcagtgggtccctgagtaaaccaccagaagaaacctaaggggcacctctgtttttcagttaatcagttttagctcaactgggatttaatcctgaaaatctaaattacatttacagactttaagttattgtgaatatttacactacatgggagaattaccaaaatatattcgttactcatacagttttcgaaaaacaggtgagacatcttccagttaaattcatcttccttttatgtttaatctattgaagaattctaaacattgttttgcaccaaattgctcccttaagttttaagagccacctagtttgggcatcagatgttctcctttatttctgtaaaaatcttgcaaattcactcccagaaagaaatgtagagaatactaggctatttcacagaaaaggcttgctgccctttcctgataacaaggtagttattattcttggctgagcctgtcccagaaagagtcttaggtgacctggtgtgggaattgctaaatctcaggctactcactgagactgtctgctgctgtgctgggcactgcagtcctccagagcaggcctgtcagcatcctaccgtgctctgagtaggtccactggggaacctggtggagtgacatcatgtatcagcctctagcagcaactcctctctgtagccccatgtctttcctgtggtacaaaggaacaagtgctacagggcatgtctgtaatcgttatcccaagggcacgctccacaggcatctaagggtgaaaggtactgccagtctgttgggtttgttatttccatagagctacacaggaaataacaccaccaaaaataacacattcaaactcagagggcaatcttccctaactattcataggcacacgtcaggcattctatacatatacccagctctttgctaagcatagtgaaatgcccttttacattgcaattaattattagccaacattgaataattattggtgagagggtaaagggcaagtgaaataaaaatagagctggtttatttttaggaagacactattttaatgtgttgattaatcagacaggtgtttaaaagcatttgttagagtcaattcacagaaaatctcttttacatgcaggttacagccaaagaaagaaataatagccaacacatttacgatttcaattgcaaaaattgtcatatttttgaacttgtgtgggtatttgaaaatattagctcctactaggtccagttaaagcttttaattctataaggtttcagactaccagctgaccactgctcagcatcccctggactccaagggtttcatctaagacatctaaggagaatgtctacccgcacatcgcactaatgcccatgactgcactgcttgaaccatgaggttattgaacagaaagcaaatccttttctgaagagcctccaagatgtggatatttcagttaatttcagctccctgccagctcagaagaatgatgctgtgctgtgtgctgttcccatgaatactacacgcagggcactgctcagtgactcagccttccagggagccagtcagggttttgaagctgcatcgtccctttcatccttgaagttcttttggatttcatcaatggcatggagggatatttttaaaacaatggagatttttcaggactggcaaaagggctcccctcgtcacagtgccaaaaccatcacaaacataagttatgttaaaaaaaatcctaaactaaaaatatctggtacttagggaactaaaagacatctcatgtttgctatcatttccatcagagctcaggtcaatggacagagatcaataccaaaacaaacatgcatacttagagcataaattcagataaatgctggagaattaacatgtagatagaagtaccatcatgcctaaaacaaaaactcagtccaatggttgtttcagtgaactgactagccttcatagagaaaagtttattcttttcaaactgaagttaaaagatattcggtgcttcattcgaaattttctatttcatgatttttgaagtagtgatttagaactctttaggactatagaaaatcatttttcttctaaaatgttgtcttagtcctaaattagaaaaaaaaatagtaagaaattaacaaaacaaaaagttaatagtattattcacatatataaataatgggccatcatggtatctgattttgataaaaggaaaatatactctgggattatttttccaaattctggcactctatttatgagtacctagacagacactagagtctcatggaatttagtattagaaatgctactttggagtacatttgatgtcattcaagttaaaaaattaaggaagtagattttcaaaataggtagcataaaatgtaaaattattgaatgttggagcaagaagatcatctaatgccctagcagttcttaatgttgcttgggtcatggatcccttaagaacacgataagagtttaccttcttcctccctagaaaatatactgctttttcttttataattaaaacaataatatgaaagttaatcttagtccagaagtcctaatagcccaagaatagaaatgtcaaattcatctcatatcattagtttgtaattttccgttgcccttttaattccaataacacagaagctgtaaaactgcttgtcatctgactttttatttgtcattacccaattgagcttcttatattacagataaggaaattgaggcacagagatattaagaaacttttccgcaggaaaaaaaatctgctagttattgagctgggattcaaattcaggtagctgattctagtgtgcatgtgctaaccacagcacatactgtggctaaccatgcctacactcatgctcaaaactacgctgtgataggtcttattagcatccccattttacagacgtggagattgaggtgtagagtggttaagtgacctggcaaaggtggcaaaactagcatcacagtcagccagtctggttccagaggtaggaactaaaccaacacactgcccttcacatgcctgtgtgtgagttcgcacacccacacaatacatgaatttgtacatatgtatcttagaggtcagggtaagctgaggatacgcatgacaaatgggattagatatgactttttccttctttctttcttagttttctaattattttgttttaagcaagcattattttggaataaaaattataaatattatttttaaaaagcaaacaggttgataacttaaaatgtgttagctggtgaaacgtccagccttatggagtaggcccctgaggtatagaaatggttttgatggcataggatgtagccttgggaatgtcctggaagagtaggagcggccagttaggcattaacactcaggagtaaggagactgcatttgggatgctcagctgattggagggtggtgttgagtggtcccctgggcagtgagaagagaggccaatagcactggcacaggaggacaagcaagttgttctaagtaaactctcaaatgaactgagagataaaaactctaaatttggactgcttcacaatttgcctaaggctggccctactcaggcctttgccagctgttgttttcttttaagcctctgatctgcaggaaaacagtcctgatttcacaaagctttaacagaatttttataaacgcagatttggggctccatatccacaaagttttccatcctttattttgagaatctgcatatttaacaatgatcctccccaaggaactgcaatgcaaatgtccaaatacagtccttggtaatatgtgttttcacagggtgaagtttttgtccaacactgtgagatgagagctgggggaaaaaaaatgaacattaaccatagaacaggaatgcaaattttctgaaaagtagagcgctactcctctcctctctttttctccatataattgaagagacactcaaattgattgttttcccattgtttcgaatggttgctccatgtaattactgaactgaactggtagtttggggggaataggggaaattcagagaatgttgtgtagaagtagaagtctacctatgtcaatgacctattttagcatttttctctattaactggctaacaattcgcttggaaactcctccagctgaggctttgttaggctttgctgaaaataaattaggtgactcattaaattgttgctggagttaaaaaaaattaggcttattgattcttaaatttctgctaaaaatgttgctaaattaaatataggttattgtctttatcaaaacaaataacccacagcttctgtattgctttatctgtattcaaaagtttgggccgggcgcagtggctcatgcctgtaatcccagcactttgggaggctgaggcgggtggatcaccagaggtcaggagttcgaaaccagcctggccaacatggcgaaactccatctctagtaaaaatacaaaaaaaaaaaaaaaattatctaggtgtggtgttcgggtgcctgtaatcccagccacttgggaggctgagtcaggagaatcgcttgaacccgggaggcagaggttgcagtgagccaaggtcgtaccattgcactccagcctgggcaacagagcgagactccatctaaaaaaataaaaaataaaaataattaaaaaaaaaaagttcgaacaacaaggttatgttagcatttatcagaaactaatgataatttatgtggtattaagtagggtagtatcttgaatgagaaagaatactgtagtttggattctttggaggaccttcggtttatattttatttgcaattatgtttatgcttattatttctgcttactttgtgactaaaagccagttaaatgtgattctcagatttcattttcagtgtttttattagaatgtggtcttttaggatttaaacctattttcatcttgcaagtatatattttaaaagtgattcatttaaatattctgctcagcaattagcacaaatgttgtcactaaattattacaatagtagctattaacttcaataagtaaaataacagttccctattgtataatatatttagaaaaaaatcacttagtggggtgcatgtatgtggaacaaggtgaagactacctatctcatcacagaattcctcaattaagaagaaagtgctcttaattacatccaatggcatcattttcatgaagataatcaataacaagtgacttatttcagtgtctcaaattttcaagtttatgcatccatctacttcacagcatccatctccatgggccccaggctgattcttgttatccttgctcaacctatccattctcacagtaaaaagccatgagagccattattttttaggaaatgtgacccattatccccaaatcactgggaaaatcaccttactcgacgggtccttatagctatccctaatatcttgttgatttctcctttaacctttttactatgccaatgaaaatggagcaatgtataactcaataaactccaattcaactgtcaaatatccctttcttcccaaattctgtttaagagtctgtgggcctcttccaactacaatccctgcacacccatccttagcattagccattgtacttttagaggaccaatttgtaaacttgatcatatcaatcttgaaatctaggaacaaagaaccaaactgataagctcttatatccacactcaggagctcatcttccctgattaccttgggctccaagtaccactttcatgagtgcctcacttgtgtagaatctcaccatggtacagctcatcacaccattttattatccagcagtggaaatgtaaattcatatccttttaacactcacaaaaggagtcaatttcagtcaatttttaggaaatttggtgaaaatttagttggttattatcctgttcttcaaaaagcacatcattagacatacttttaaaaaaccagagaataatcttaccttataaagacaaatgacacatgttgctatgagtttaggggagggttactaaccttattatcatgtgaactgtttggaattacctttgaaccctctatacatggatttctgtcggaggcctaagaactccttgtcaggagaaggaaatggtagaaatcagatgaatggtgaagtatgaccattagaaaccaccctctatacacctacactgcctatttttacatcaaacatagcgaactgtcctttaggaagcagaaaaggcagagctgaggaaatgagaggcacctctcatgtctttaagaaaacaactaagtggcaatttctggaaaataggttattgtttgtcaggtattagcctgaaattttgcttgaattgtttctccctaggaaatgaaagatgttcacttcttagttgttttggaaaaacaaatacttactaaagattataatggctatcaatttaaacaaacagatgcttttagtgtctttgtgaataacactagtgaatttgcaagaattattgctttaccaacaaagcataaattcccatgttgcttcagtacttgtgcagtgtttgttctggagcctctattcaatatcaaccagcgtatagtagttcctccgtgagagtctcttgtaaaaacttacattcattcttgttattattttatctgagtgaatatttgacaaagaccaaagaaatccccttgagactggtacccattttctctaatttgaaagatattgactaattttgttagatcccaccatgaaggcaaaaggaaaatatattagctatcactgtggcttaaaacaagaaattatttattatttttaacaaatctgaggggcaactggtgtttggttgatctatgttgaacttatggatagttatgtgagtgtcagatagaatcagacatctatgtgagctggcgcatctccattccacattctctctcatctttcttctgggactgatgagcttgcctgggtgtgttcttctcgtggagatggaagaggtggaagaaaacaagcccaacacaaaagcacattttcaagtctctgtcatgacagttactgacatcccgtgaatgagggcaaagacaagcagtggggcaggtcctcccacccttgatgggagggctcagaatgaatacatagatgcaaggagtagggatttggggccagatgatacatcctaccacagagaggtaggatacagggaaattctaggccctccagtccctttgctccaaataatcaccatagttgagacttgaactatgagagcatcaagtaggaatgccaggtgagcttcagctgctgcccaagtgtctaagaacactcattcacctctcagatactcacatacctatgaaatgcaccaattttatatcatgagccaaagtaaaactcagaatcattgaaatatttgtctttgcatagaaagagtcccatatggaaacaacccagcctacctgcttgacttcctgcctgcctgcatgcctccctactccctccctccctcgctacttccttccttccttccttccttcatctctccttccttccttccattctccctacttcctgactgcctatgtgctttcctccctccccccttccctccccccttccttctttccttccttccttccttcccaccttccttccttctgctctccctcctttcctccatttctccctctctcccttatatttcttcaattcttatcatttgagtatctagttaatgagttctcatttgatgttatagatttttttagctcttcctcacctgtattccttggagtaaattttatgaatcttagaaacagagtctggctgataaatttattggtgcatcaaactcattgagaaatgtcttccagtttcatcttccaaaatgttactagttctaaaggtagtggttgatagttcacacaaaaaaatcaatactgattcagaaataacttgctcatcagggaaataaacctggaaggttttagtcataatttatttataatccctccctttgtgatattcagagatgaaatttgaggtgaaaaaattcaagtattctttttcatatattttgaaaatataagagtctttgatgtattctgggagctagcatcttgaaaagaggaataaaaaatgacttatctggagttaggaaggtgctagtccatcacccataaaccagttaaagagataaaggtgatttatcagaaagtacaacaaaagtgataacaatagaatattattctccataccaagcaagttacaggtatcccctgctctggacaaatgcgtgatgtgtaaacccagattgaccaagggcataagggagatgtagatctgtagctttagcacacatgaccaaggtggtgcacttggtgtaggctctcggctgattgctgactttgcacacttgcggggcatttcatgaatctaaattcgggaataagatttagaagctggcagatgacgaagagattgtttgggcaaccaggactcttgtatgtgacataatcaatgctgaagttagttcatcatcccattccttgtatttccaaatctgtgatgcttagggccttatctagtgccttttaccaagtgggtgggttgtagaaaaaaaaggactaatactcattttctttgaaatataagcttttgaaagaatattttaaaaagaggactaacattttagctttcatgtaaaagtttgaaaaaatgcaatttcagtacttggaaatgagcattttaagactccttgttgacttcccttgtattttaatgcatttctagagagatgtctgcttctgcattgcttccccatgatttacttcagttgaaagttcagccagatccattattttctttctttgacacattatgcaaattaaatgcaaaattcagtgatgagaggaaaaggtctcagagcattgagcagatgccgtgtcggtaatagagtaaggcaattacaaaattacttgcagccactgtgactgtgtattttcccgtattctgaaaagaaatctgtcatgtgctcatcactacgagatttatttttccattgatgtgtgggagatttatgcatttaactgtcgtacacattgatgagagaaacatgcacctacagaaataattttttatagattagtgagatatttaattctgactttcttttccactaaaatgatcctttgtaatagtcttctcttcgcctgtattgtaagtatgaacatcagaatggctcagtaagctggaagagcaaaaccatgtctgtgtgtagaattccaatgccaaaagagaaataccacttatcttccacttctataaataaaggcaatagcaaagtcattaacaagagcaaggggtgaattcaatgatctctaagatttttttccagctaaaaatgatatgattcttatctattactaggaaatagtggtattgaagtagaattatgagctctacattcagtctacttttcacatcggattgtcatctcatttttggagggtaattctctttagattctctagtcctaagctgtaatatgtcttatagttgtcatattttagtgaacaaaccagaaaaaaagattgcctgcatcatatgtaatttttgttcaatccaagggcaatatcgtagaatacttgactcatagtttaaaatgatcatttttattgagttcaaattaagtcttctgtagatataataattatgtgaatcaaaaatatgtatttgtgtgaagaaatgctctttcttttcaggcttgccttcaaaaaaagttagtctcatactgaatggcaataatttcttcttcctgcctcctaagaatacattgaggatataaaattatgagactagaatgctcttatttcaaaaacattcacagtaggcattggcctgagcaataattgtgaatgtttcatatttagagaatgggtagattattaaatatgaactatgaaaatttctacccttctggtttttctgtgggatataatcctctggtcttaaaaattaattttagtaatggattttcacaagttcccttggagagcatgcttggaacatttttgtgacatacactcttgaggttttccttctaaatttcttttcatcactcattttgactttcagatttcttaaatatttgttattacgtgtatctttgtaaataaaagtgaggcttaagaagtttgactttgttttaggatggaaccttgttaaaagtacaagcacacatgtgttgacagcagctagaggaagcgtgatagtgtggaaagaaacagaagtccaaagacctaggggtacatcaagttccattatttaattgtcatctttgtctttgctactgaaagtatggtccacagaccatttgcatcagcattgccagggagctggttagaagggagaatctcaggccccttctagacttactggatcagagcccgcattttggcaacattaccaggaactcatatacacactcaaatttgccaggctctgaactctataatctccagcattctgatttctccaagtccctcctttctcatctttgaaacagagtaatttctacctcacaagtctagtcgagaattaaatacaaacatgtaaagctgctgtgttcggtgcctggcatacatggctgtcccccattcctgccaacacacaccttcaagcaagacaacttgagagaggctgagtgggagagagggtgaataaatgttaataactcacattagagttggcattttttttctttttacttgtctctattatatagggtgactgtattaattgtgcaatacctttgcttttaaataatactactgggataaaagtgagattctaatctcacatattatttcaagataaggttcagatacagagttttaaagaaccacctataaaaatcaaatccacataaattcagaggaaaatatcctcaatgcttatataatattggatgtttagggtgataccctctaagcacaacttcaaaggaagaaatcattagggaaaatactgacatatttgagtacatatatgttttaaaatttaatttacttgaaaaggaatgaagataattaaaaaggaagtcacaaattgaaaaaaattatatgcatagacaaagagttgataaatttaacatagaaacaggttttacaagacaataaaaggataaatgtaatgattttcaatagatataagacattaataggtgggcatgtaaaaaatgtcaagataacatgaaaaaattagttttactactcataaaagacatgcaagtgaaaacaaccaagatgccatctccagtctatcagatttctctaaaaatgagaaagcgctcataaccagtgaaggagaaaaggatctgctttcatcttggttaagatatacattgcaacaatatttatgggaaattctttggctatatctatcactatgaatttatgcatacatttttcacccaataattatacttttgagaagttatcctaaggaattaatctaaaactgaaatgatacatgttcaaaattttcattaaagaaaaccaccaaactgtaccataatgggaactattcataaatatgtaaattatgtccatatgatagaatactaggcacccattaaatcatgttgtaaacaatatttttattgaattttttaattgaaaccaaaaaagagcaagataaactcagtatacatagcatgtcatttttgcaaatgtgtatgcaaatgtgtaacatgtatatttttaagattggaagctggtacactaaaagtgaatgttaattctgggttatgtttttcccaaatttttgcctgtttctgccctgcctctttgattttaacattgagcatacatttatagtttaaagactgttaaaagtggcacttagatatagcttaaaaataattttaatagcacagggaaattattttattaatgctagttaaattagacgaaaatataaaattttaatggcagaaatatttcaatttataacatatgcataggaaactgaaaagagtagttagctctaaatatggggattatggataaattttatattcttcacttttttatttcaaaatttttataattagctttaggatttttataaccagaacaaattacatttaagactcccttctaaacttatttgcttattttcaatctcaaattgtgaatttgtatggcctctatatttccaatctaattttacagacattaaatttctcttgaaattcagtgaaaaattagcagagtcgaagttacacttctgtatggcatttaaattcctcctcccagaatacagccactgttctacagtacagaggagtccttcatatcacgattttcattgtgtctaagaggcatgtgtttccactttgtcattatttggtctaaaaggatttttcttctattttgctgctgtttttgtacaagacatataaagaaaggtgttaagggagtgttaaatataatcaaggtgttaaggagaagagcccagagagagaactcttaatcttttcatctggtccagttgtcaaagtcttttgtctttagccatcacttttttaatcagagacatataatctattaactatgggaacaagaaccacagatttagcctgtgcttatctggaaacctcccctaaaatactactgaacgactctttttttttttattcctgtctctttttctgttgcaaactgattgtccactataacctggagaggggactcaatttttagaaactgtcttatacacctcttaattagttacctattgctgcatatacccaaaatttagcagcttaaaacaataatgaaattttattatgcccacagtttctttaggtctgtagtaatttaagagaaacttagctgggtgattatagctgactctctcatgatattacagtcatatacatcaggactgcattcttctgaatacttgactagagctggaagattcacttccaagatggctccctcacatggctggcacattagtgcctgctgttggggggagacttcaattctttgttgggtggtcttctccatggggcagcttaaggatcttcatggtttgtgggctgtttcacaaagtgtgcgtgatccataggagattaaggtggaagctgcaatgtcttttatgatagagcctcaaaagtcacacaatgtcattcccaacgtatcctttttttcacataggtcagccctacgcaatgtgagagtgaggaagggactacagaaaagaatgaattcccagagatgagtaggatcatattgggtgccatcttggaggctggctaccagtgaagaagactgctttctggccctcagtgatttacttccatctcacatgcaaaacatactccctttattgtggttcccaagagtctcattctattatggcatcagctcgaagtccaagatcttatcatctaagccaggtgtactagttttctttgctgtctaacaaataatttaaaaaatgtagcagcttaagataacacccatttacatgtcacacctctgtaggtcagaagtgtgggcaaagggtagctgggttcttagctcgaggttgaaaccaaggtgttagccatggctgcggtccttatgtggagctgagggttctctttcaagctcatccaggttgttggcagaattcagtcacttgtgactgacagactggtgttcctagagaccacctgccattctgtactgcgtaaccctcttcacaatatggcagtttactccttcaaggccaacagaagaatcttcctactgcttgggttctctgacttcatttgaccctgacctctaaacccagatttaaaggttttatatgattatatctggcccaccagcaaaatagtcctttttattaactcaaagccagctgtttagtaaccttaattatatctgaaaaaaacagaatcaaaggagtggtatctcgtagtattcacagattctatccacacttcagaagtggaaattacacaaggcctgaacatgaggagatgggaatcttagaatctgtctaacataccaggtctatgtgcaaataagatcaatctctgttagtttactcttatggggtaattaattaccccaaaacttagtggcttaaaacaatagcataactaacttctcagtttctatgggtcaagaattcagaagcatctttcttcagtggttatggctttggcactcatatgaagttgcagttaagaagtcagtcagggtgatagaaatataaaggcttgactggggctggaggatgtgcttctaaggtgatttactcacatgatcaagttggtattggctgttgcaggcaggtctcatttcttccgcaaatgaaatgctctccaggctgcatgagtgtcttcataacatggttgctgatttacattggatggagagatcaaagaggatgagaggaaagcagcaatgtgttataggacccaacttcaaaagttacacatcattgcttctgccctattctgttgggcaatcctgatgcaatataggaggcaccatgaatagcaggaggcaaatatcatctgggctttcttgttaacctcagttaacaacaacaaaacaaatatttaaaaaactaaaggaaagagatttctggaatatttccattctctgtcatgcccactgccatagtctactcaagttctcatctcctattggacctctgcggtagctttataagtcctgtccttgtttccaatgtcatccctttcaaaacgcttcaaatagcctccttaaagccatgactcctcccacggttataaccctgcaggtaaaggcacttgaggacataatctgtaccatctctggcgtcatccctttcattccccttcacctcccccaactatttttgtatttcagtcatgctggacctcttaatgtttccccaaaacatcctaagcaatttcacgtctctatgccttttcttttcctgttctctttgcctgaaataagaacgacagataatagtgactatgcaagtcctaaaatcgaggcagccacagtgctaaatcacacattggatagttcaattttattcttataacaaccctttgtggtaaatcttattaccatgctcattttacaaatgggcactcctaacccgatgtgcataatgattaaaaacatagactcaagaaaagtttggaggttctggcgtaaccctctttgttattctctatgcaactagcttaaaaataacaactttgattattctaatctattaaccagttttcagtgtgtctgaccaaatcagttgaattttatttttttaaatatgtgtgtgtgtgcatgtgtcagtatgtacgtgttaaagagtagagggaggaagttgaaaatctgacatttgatttatttctcctgggacaaaggaagtttggatatgtcaaactgctggctaatcaacacgttaatcaatgcaaatctctagtatggatatagttatattttgcccccctcttcctttccaaacttctttccagtctcatgaccagcttattggcttcatattaccaagtaaatatatcaactgcccatatgtatagtacccagacaatgagaacactgcctaaatattgtgttttcaatactacttgcttttagcaacaaatcatagcacccagcctaactttaaaaattccatgtcatccaacttcaaactataacaaaaattgagttttacagaagagtttcaaaacatttttatgcattagacacttcagaaattatctcttaaaaacaaaacaaaataaataagggacaaaaacaatagaaaacgtcaggcaccaaactgtgaactctcttttgtccatgtatgatttaaaaaaaaaaaactcactgatggtaatttaagaaatttgacctttaggaaaatcaggctgaggctcatctttgtactttttaaaacaagtcaataaaacatataaataatagagatgagtgcagctcacaggggacactcatattttctaggagcctgtggatataaacaatgaatttcatgaacacagagcacatttctacatgatctccttttctttacaagttatttatgttttactggaaatattaaaacttcatgtctctttgttgctcttgtttctttaaatttttatttttatcatcagtcattgttcaataactcaaaatcatataaaataaaacagtttcaacatcattccgtactcaagatgatctctattaaataatgatttttttcttgaaaaagcattctataattttttttagttttccagatgactatttaaaccaaatgtttaaatgaatgattaatgagtcttttatcttatttatcccacctgcctactgcaaaaagacatgaatttaatacattttagattttaaacagttgtatatctgtaaaaaaacaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttgtcatgtcaccacctcagtcaacgaaataggttctgccatttctcaaattttatggagaattatcctgatgagttaaggcagaggttgaaaacttgcagcccttaccccggttacggattttatttttaaaacccagtgtttttgaacactttacagctgatatttctattctaatggatgcattatcttcttttaaaaatacttcctatattagccctcttaaggggtatgaagtggtgtctcattgtagttttgatgtgctttactcactcttaataccgttattataggttatttattgttaaaactgtgatatattttcctttattttctacatatacatagatacatgcagtttgataatctgcatttaatcgcattagaaaggtattttgctatgtcattaaaatttttttgtgaacatcatttttagtggctgcaaaaacttacataaagacagacatgtcctaatatatgtgtgtgtatattttaactaaatattggcacaccaaaaataatggatttaatgcaactagcaatgataatgctcaaacaacaggagtgctatgaagacaatgaaacaggtgagttgtcagaacaccttctgtcattacattaacttttttaagcactaaattcacttgaaattacaataaacaagataagtacaagcattagataatttgacctatcagatatcccaaaggcataaactatcactagagggtcttttctttatgcaattaggtgaccagtgactcttattttttaaagcttttaaaataaaaaaatagctttagggataaaaccagccagatttttatcgtcaaaaacatgttcacagttcagctaagccttgctttcttttgaagaattgctctttataatgctcaccaatggatttagaaatatcccattgtaatcatgaagatctcaattatatgttatgaaataagaaacataatgaaatacttgaaccttcctgccccgcatagcagatatatttttgtatttatgatattcacagtaaaaaagctgtgctgagaagctcaaaatagtatttgatcttagtggttttggagcagaggaattggcattgccatgatttttctataacttggcgcaggccaatggtttcaggcaggactttcagagcagacttctgtcaaatttgccatatggagttactgggctcagattatagaggttttcctggttgtttgcctaatttgggaattatcagtgctctccaggattttctccaaaaacaaagaacatgttcagaagaaactgacacttcaggaagaaaagtagtttgatatttgagaggtttagatggtttctaatatttctaaaaggtaccatgactcgtgaagaatttgactggtaaaaaagaaaggttcctgttatccctggaacacagctaacagtctggcatgtagccttacctgaactggtaccctccccgtacacctcacacttagcattctgcacagccaaagaccctgtcagttattggccagcctgaagaatgaggttgaattcaactcagggactgaaatctactttatagcattttaaaatattgtagatccaaccttgagttgacctactccgcaggttcatgggtgattaggtgtgagatacaatgggaatgaatatctgaaaaccctttgcagaagagaaggaggaggaggaagaataaatccaatttttacaggtttcatattctggacactagaaaacacttcctcctcacagcgccgagttgtatgaaaaggcagctcaattgtctttccttgagcagccttgtgtgcctgggtattcccttccatctctcacccatggagttcatattcctgttctcatgtcaccacctctgtcaacgaaataggctctgccatttctcaaattttatggagaattatcctgatgagttaaggcagaggttgaaaactcgcagcccttgctccaattacagattttatttttaaaacccagtgttttttaaaaaatcgagggagtttacacaaaaattcatgttttctgtttctctagaaaacagcaaatctggcaacaccctgctcacattcccacctaccaagaatgctgcacattaaatggtggcttttctttaggtgactctaattcactggggtctccatgtgacgtttcagcctttgcaccctacttgtccgctgcaggcccaggagctctctactcctcatatgcattacaggaccccatgcacattgaagatgttttctcaggcagagcagacaccaggcaaatatcttctggtcttaggagcaagtcttctgagaatcaatgatgacaaatatcttaaatggtctactcgatggttctgaaaatgtaagagctaaactacctgtatcaaaatcatcttgggggcttatttaaaacatatatgataaggccccacctcaaacctaaggagtcagaatttctacggaaaggcttgggaataggaacattaacacaagcatcccgggtggtttttatgaaacaaagcttgagaattattgaattcttctccgatctgacagctcttctcctgggcagacccaattagagggaactgatgagttttaggaaatactgtaattctaactcatcagtccagcagtgctgaaaatgcagaattttgtccttatcaaaagccaattaatgctaaccttttcagtgtgtgtccagtaccaccatcggtaaggtaaataaacaggcagttttgcatataatctagtgatttttaatttagttttttcccttactcatcctaaaaaaagcagggagtcattgggcttttgtatctattttagctgagttattattttaacccctatctttagtgcagaattaaaatatcacccttctatttgcttttattcctaatatctgaatggtttcagcttgacgcaattagcatgtagagcatgctcacctactgtaatctcccagatgagtcactcagctccagcacataactgcttctgggatcctgttggctaaccaggctttgaaacccagggaaaagaactgtgtgttttcttcagaagtaatccataaatgagaaattaccataaataggcagttttattcactctaagtgatttttacataaaaactgacaaggccgtaaattgtatatagaatcaggttccatatccacacagctaatgcacacatgaattattcgatgaaatttgcttcagtagtattatctgaaattggtttcagacaatacattaaatgttacacattatggtaaatttactgtatttttgttccagccacgtcttgtgttggcaaatctgctaaatttaagtttgcattgtattcacatgtgttgctatttcctgagatgtcccaatatattttagccatcaaacaaatagaacttcacctctctgaggctcagtatccacacttgtttatcatgcaagagacatgcaggtgagaaaataggcaactgccattctatctgtgattgctgttcatggaagaagtaaaaatgagctgggacaatatataggtggcgccagggatggctccttgaaggaagtgatctcacagctcagacctgaaagctgagtggaagttaccagaggaaaagagaaagggaatgcattggttttctattgctgggtcagaaactaccactaactcagtggcttaaagcaccattcattatctcatgttttccctgggtcaggagtcaggtgcgtatcagagtctcaagaggctgacatcaggtgtttgcagatggcattcatgtctggggctcagggtcctctttcaagctccttcaagttgttggcagaatttagttgctgtggttttaggaccgaagttcccactttcttgctgatcaccagcctggggcagctctcagccccttgaggccacctgcagttcctcatcctttggcagatcctctcacaacgtggccacttacttcaagaccagcaagagaatgttcctcttcaggaagggcccaactcctccttatggatgttcttctgattcagtcaggcccacccaaaataattgccatttttggttaactcaaaaatcaactgatttgagatccttaattacatcagcaaaatccctccaccttctccatacataataacctaatcatgggagtgactgttcatcctgttcgtgattaggctcacatataagagaaggagatcatataggacatgcatgtagaggatagaatcttgggggccatcttaaaattgtgcctaccacaaggaaggattttccaggcaggaagaaccagatatatgaaggaggcctaaatgacaggatagcaatttccagtgtctgaggctaaggctggaatgctgacctggccagatcatgcactgctaggtttaatggcctatgcatactctattatgcaattattaaaatacctgtttacaaagaatatttgaaatattaaaaaatggaaaactgcataccgtaaaatattaaatgggaaaatcaggatatgtgtttatataacatagtatcagttttggaaatatatatgcatatcttaaaagactagaagtaaatacatccatctgttagccatggatatctctgggtgagaaagtatggatgagttagagattctttgtcccttttcttagttctaaaatttgccacaataaatatgtattctcttataataataattaattaaaaaactattcatggtacttgcaaaaacaaatgaatttgagcagtctctttgaaggaatcaaattttgtactccaggtgtttgagaggttgaaaaacaagctcaggaattagctgcgcatgatctgtacaaacaaggggatcagtcagtggaaatgaagtccagcttcagccaagggtggtgagtataacagacctactctgatatgtttcatcactaaacattgagcaagaaatctagtgtttaaattatggaggcattaaagcaattaacctccctctacctcaattttcttatatctaaaaattgaggggagcaaaattccattcttgtcacaggtctcaattgcaagtagcatgcaagcaagtaggctgaactcttgtctgtcaatctagctccttcctggatggggtatttaatcagctctccttcccaagcacccagtggacttgaagctcacagttagacagagatggctagaggtgccaagtgctgtttatcataggtgacatcacctgtgtgctcagagttataaacataggcagcttgcctactgccaaatccattacaactttcagaggtgttcacttaggaagaggaggaaagagttttttgagaaccagatgggaacttagaaataagtaacattgacaaccaaatccttcagacacatcttcaagtttcaagagagcagttaacaaaaaagaaaaatgtatttttagaaattgtttgggaggtgaaaggatttttctgggggggagtagggtagggaatggatagagatgatttttttttggctctgcaatatctcagagatctttgagttgaaatataacaaaatgtatttcctctctcttgctccaaaaactgaaaagcaagtgcactagaaaatgtcagagttggccactgaacagaccatatttctaattcatggcaagatggctaaaataaaaattcttgaaatacgtattttaaaattagattttgacctttgatagggcttatcatgctatttatattgtagcagaaggaactgattttttagtagttgcctcatcaaagacatgactcacatttccttaagcatttacaccatatgtttcctgaggtaaaaaaataaataaataaattttatattttttatacaattagtgaaatgtgagcaaaaaatataagaaatcatttaaaaaatattttggggaggatgtggtctagaaatgttgttttctagaaattgaaattatgttagctatttggccagtgtagccattaggtacatttatgaatatagatgagaagtaatcattgtgatgctagttttatcattaaggaaaaaagcagaattcaaaagtttagcaatgaaacacaggtactactgaaactcactttatatttgaaaatgtgaatgtgagtttaaaaaagcttttgttagactaactgaaaagaatcattttaacatttaaaaagaaaaatattattttaagtgacatttggtgacattattatatgtgtacaagctgtgactataagataatgagacaaattattatgtggccagtggaaattaaatttatctttatgattactagcaacagggactattttattcaactatctttacataatacaaaattattgtaaaatttctaggaaattcatattccacttaaaatatgaggaagtacatttggaaaaaatattaacatatgaaaatcagcatcccagttaaggaatccccagtttcccacttggtgctcaaatcacttcacgttttatttcattggtactttttctagggcagtagatttaggaatagaaaacagactctacacatggaatacactaaagtcttgaggaggtgtgatatttccctaagtttggataggtggtatcatcctttcagtcactcttgactctgcattagactctctacctaatgatccccaagtcatttcacttctgccttcttaacattttgaagatgtcctctaaaatttcaagtcccaccatctctgcctccgaactcacctccctgactttcagtcttgaagcaccttaacaacccctcccctcctgtgcatgttccacctggaaaccagggtgatcactctgaaatgccaatctgatcagtcatttccctacttttgaaccttcaataacttcctagcacctattcctagaaaccattccaacatatcacctaggcaaaggaaacccttttcttacctggctcctacttatccctccagattcaccttttgacacctcccacttcatctctctgcagcccccttcctgcacacacacggagtttcagtcttgccaaactcttcgcagcttcttgagtggaccttgctctctgcactacaatctctttctgcctagagagtcctttacctcccccaatctggttaacttctactgtttatttaagtcttaactctaagtagatgtcatttttgaggatgctctctctgttcccactttggaacttgggcttctctgttgtcctggtgtcccgtgtattcctctgtcatagccctcatctcattgaattgtaatcatgtcttcactagtgtttcctttctagcatgatagatttttgtattgccagtgaccccaacaaattccccaggtcctagccctgtgactggaacacagtaggcatttaataatagttgacaaatgagttagtatatgtaatgaaaaatctacctgcctgagcattaggaaatataaaattaatctaaactttgccactttctgtaatatctgtgtgtcagtcaggaatgcttttggctgcaagaaaaccccactgacagtcttttaaaacaaataaggaagtctaaaaggagtcagatgctggccttggttcaatacaatgttagaggcagcatctcagtgcttctctaatggtcacaaaatgactacagtaactccttccctcacatccacttccagttcaagaagcagaatgagagacagcaatagccaccctgtttcttcatcaagaaagcaaagatatcttagaagtccccactgtccttcatttacttctcatgggctagaattatctcagtggccaccccaagtgcaagagaaactagggaaattagtttttagcattcccacactctatgttgaaaatgagtaagagacaataatttggggaataggtgtgggattagtcagccaacagtgtttgctacaccttgggacaaaacattttacctctcttactctttgattctttcattgagtgaagaattagaataagtaatctttcttcaagaatcaattttctctcatctataactcccatatattcttatttccaaaatggaattaccttctacaccagacagttacttcaagcttttcccctgaatatttcacatttccagaaagcactatattacaaagaagcccttccttttcaagaactctatttgccataatgttctccctaacaagggctgaacagtacgtgcccagattccctgcctctgacctcaccacaccctcttctgtgtggcggtctctcaaattgtttaggacaattatcatgacttctctaaatctccctttttccaggctcaaattccctatgcttcagtagtttttcagataagccccttctgtcccttcacaaccctggtcagccaacaccagacatactctcttcatttacttatgattcattgaacagataatcactgagttcctgccatgtgtcagcactgctctaggagctggtgatatggtgagaaacaaggaagggaaggcccctcctctcatgaggcttacagaggagcaaaggaatcagatgataagataagcgttacacacacacacacacacagaggatcatttcagagagtgattcgtgccaagatgaaaatgacaaagggagataggagagtgacaagggatgtgtgtgtgtgtgtgtgtgtgtgtgtgtgtggcagtgcacgtgtgaaactagaagacaagccttcagatgatcagggaggtttctctaagacctgaatggggataattaactagcatggaagaggaagaggttttgaagcaggaggactttgtaagtgaaaggccctgggtagaatgagctagacctgagccaggaaaaaaaagatgctcagagggggaaagtgttggaagatggcctgataatgcacatggggagccccccaccacaagctcatgtaggacaggacaagaactcagattgtattctaaatgacagtatttcaatacccatcttaaaatgtgtctggacaaaacttaacacttagctacacatatagcctgactggagcagtccagtttataacctctccttgtagtgggcactgtatttctatggatgcaagctacagttatatgacttttgtggaagccatgctatccccacagttccactgtgatttcctatatgctctttgatgcacactgctcacatgcatgaatattacttgcacaaagagagagagtaggtggatgtgatgccaggagctattagaatgattcacattacacttccaccatatgaaaaataatgtacagtctaaagcaacactgcatcatatcatcgagcagcttgggaaagcctaaattacatatttgaagttcagtcagtcattgaaattagataatctggatggtcctgaaagtgtctttcttgagagctttcctccaaaagcaaaattgaatggtaaggaaaaaaatgaagtacaacaaaaatgacagcaaaaaacctgaaaaacaaaaaacaaaaaacaaacaaacaaaaaaccccaaaaactgagtaatatcaaccaggcaggagttgaaggagagaagcccaactgttggtagataacttgggatgagccaattaaatattggtcttctctctctcagaggccctaattgcattccctccagcagccacaggcctggggttttccccaggcctgtggcattcagacatcagagctgagaactccagtgaccaccaggctgcattttaatgctaagctgggagcactgatactctccaagacagccttgcaagctccatcttccactgactcaacgttcagtggaacgttcagtgtgtttcatctgctgttcagtcatgcaggcagcagggatcctgagggctctcctccccaatatggtaccaagttttgattcatccttttcctcttccctatcagcaggtattctagaagacagttttatgatgacattcacagctagcattaaaaccagataaaaataaaacaggatgtcaataaagaactaatgatgtgtgtctgtgtaaatgtataataataataaaaagaatagacatctgtttgtcaaggtaccatttaaggccttggggctttaaatgaaactgctttataaatgcaccaacatatgtgactgtttgcctacgtctttcatccatgaaaattgccctgtagacagttgcctttgaggtgaaaagcattctataggcactaaatattatgctagaacacctctaagtgctaatctaactaccttcatgacggaagtttcaggagaacaatttaagggtcatggaaaaaaagtgttaaacgagttggtaatctgacatttcctaaaaactagattcaaaaccgaagggaaagtagagagaggaatcaaaactagcctagtaggatggaagtaggcctccctccttggaggtgtgaaaatgcctggaataatttaggcaagaatgccaactgtcagtgatgaccttggtttaggggcagttatagcatggtggaaacacccctggactggagatccggcatcccttatggggatatgaaagaaatttggcaggtctcttaacctctttgacattcctttcttctttgttaggtaagaagctggtgctggttcagtgtaatttgaactgtgttctgcatgactgtagggttctgcttagtgccacgtggaggtggggatgccttgggtgaagatgaaggaggtgtagtaagcaggtggggctctgcactctttttactctccttcttccagtatcatcagaacaactccacttttttgtctttatacactgagttatttataaaatcctagtttttttaagtgtcaaacaatgcttgattatgaaatgatagcattattctagcattctaactaaagtgtgtaaattataaacaactatctttaatggtcaacaaattgtcatcattactgagcagtgttgttagtaacaccaagtaatacaattaatgaaatccttgaaagtagaacctatcagtgagccatgcatacaactgataagctgtggataatgtatagaagaatgagttcatttggtaattatttgtacttttcaaaatattggtgaactttcatctttaaggagcaatggtgtcctagttattcttgccacaactgcatggaaactctcgaatctgttagtatgtccttgggcacaaaaacagtattttttggaactgctcaaaaattatgtagttttgtagacatttagggaaaaatctcataatttatgttaaacactcagttgtcttggtgttgattgaaagcaaataatacgtgcttaacatcctgctagttgctgagggagattcattcatcattttagaaaatgtttctgggcatcagtcatataataaacactttcccagcacttggcttcacaaaggaacaaaacagacaatgcacattcctgccctagtggagcatatattctagatgacagactgaacacctagacatatatgacaagctctttcttgcaaggagagtccagttaggaaaatgtcaacacctaaaacagttaaaggctaagatagcttctgtggacactaagtgctacatagtagttccagaggaggcagagagttagacctggctagacactggacagggggtagaattagacagatagttcctggcttggtgcctggtacatagtagttgctcaataaatatgtgttgaataaatgaaaaaccaggactgactgaatagacagtttacacatttacataataagtgtgtaatttagggaagtggggttagaatgagcctgggtgaaggaagccttgaatgagagatggagaactgtaaacgataaaggttttgaagttggggaaaggtgagggggaagtgaagtgtaacatggagaagcaaaagtgtgaatattttccaagatgcctcgacgttatgatagatgaacctctgagacagaatgtagggggaagatagaggaaagagccaaagagcctctgagggtgcaaagaagtaaagaaaaaccaggatgtatgatgagaattttattatggagctatccagtgtggatgtgacttctcttccccatatcgacacaaaacacttagcaaaacatttctctttctctctctcatgctctcctgttctttctccctctatctctatctccttttgctctatctctagatatctattagacagatgatagatagacagatacatagatagataggtagatagatagataggtagatagatgatagatagatagatagatagatagatagatagatagatacatcttggaagtggtaagacagaaaaagtagtgagtatagcctcaaaatggctgcagggcaaggtaagaagctgagctcagccttcaatccaatccctgtttacactctgcctatttatttgtttataatatactctgactccccatcgacatatttacattcttggtagaagagattatttttgatatctctttgtatttatttcttagcaccaagataattttaaccactattttattattgtaaattctattgtttttactccaaagaaatacatatttgttgaagaaaaattagagatacagataagttaggaaaataataatatcagaaaacagggccatcatttaaaacatggttacataaataataaagtactgtgctaagtattgtaatgatgctgatgcttttgtaataatgatactgatggtgaagatggtgatggtgatgatgatgacaatgatgaacacatacctcccactgattatgtgtaaggcactgttctaaacctttgtctaaattaatgcatgaagtcttcacaacagcctcaatagatgttattcttcctccctcctatttattttattttagcatattttatagatgaggtatctgaaacagagataagcaacctggcctgagtcatacaacacaaagtgatggaggtaggaaatgacccagacggtcaggctccagttttttgggcactaccaaattatattaataatacaactctgtagcagcctgctttcgagttatggaatagtttctagaataagtcacacacatagatttcgagcccaggaccatctactctgagcagaagctcctacctaaccttgactataaactgactctaccagataatcacacttggcctttctgtaagtgataagcaacttgcctctgtgggcacctaccctgagaaaggtagtcaccctgctccatgctctgtttcaagtacatttattattatttatgaattacttattaacataaatttattattatttacgtattatccaacttattaagtgatgtatatgtatgcaggtgtgtatgattatgaaatacaagatgaaagaactgtaagaaaatagctttgaaaaaattagtaatgactgggccatagcccagtgataaggcatgttcacatataccatttcctttcatgatggtaacagcccagcaaggtaactgtcatcagggctgtcatgtattctagtactgtttgtgtactgaataaaggcatttgcctgagggatgatagggctcaaatccaggctgcactcctcttgatgatctatgaacccaagaagatgagtctacctggagggaaaggcttttccaatatgcacaaagttccacagaagctagagttgtcttgggaatgattatctccattttgtaaataaggaaattaaagatcagaaagattgagtaatttctcaagaatatgtatccagcaaataacaaatcaaggactcaaacctaggccaatatggctctcacttcctttctccaaaatcactgctatgtctttcaactaaattgcattgctctgttcactggtacaaagcttgttgcaccatttaaaattcaaggactatctgattgtgtattatatttttagatcctttcctgaaagcaggttttaatggggagggagaaagtagcaactggaagagagttttgagatggtagatggtaaaatgtgcaagcaaattcccaaaaaatctggggacacagacttcactgccttcagaataattgaaaggagaacccttcaagtatgaagcttcagctgaaatttcaacgtggtttatttacctaatatgctgttcattaattacaagctattagtgactattagcctatgaaattgtatttacagttcagaaatgtatttgattttcacaagccttactggggaacaatgctcagtcaacactttcttcgcctaaagagtacgatcaaagagcatgaagcgtagtaaatgtttagcctttgaatttggagtttacaaaggataattatccacgggttggtgaattcatgttcctctctactccacacagcctctggtttgcatttacagttttgcacaatcagatgtaaaattaaaatataatcattccattttaaatggttccctgtacaattatctcattttaaatcttttgctaatgtggttattctaatgcaactatgatcattattttatgtatgtaaagatgtcaatactgtccagctgatgatattatctaatagtatgtagcaaagcatgttcccttcctacagtgcctcactctttcgatgggtaagatgggaggtgggagtggggggagcatggcattagctgtggataataaagcaaagtaagtacaataggtgttcaataaagtcatcatttttggtacttacgatgtagttttcttgttcctttggttccttttgcagtgggtgtatttgcttagacagagagaagtggcagagggagactgcatttgtatttggttatttcagagaaatgcaacttggtattatgagcctttaattctgtagggcagtctccagatcattttgatgctgaactttgtcataaaaaactattgatttttttcttccaattataaacatttgctggtttcttgtcagttaataactgacataacattatttcagacctttcacttagggctctgttgtgtgtttctcttgatcaaaattattgccttagcatatcaactgaatacacaagagaaaaatcaagttatctatgtttatcatatgcatttttgaatacctatatgtgatgcttgagcatagtggtttttataatcctgtaagcgatttttcaggagaccagatctgacctcctctctcacacccctttcacactgcctgcaacacaccacacataccacacacatcaccaccctgaccgaccaatggaatctgagccaactataaatctcaaacttgttgatattggataatgcctggaggagaaacacggctaccgttcagtaattccagaaagaatttcttctttaaactcagtaaacccaatggcttctcagaaagttctttctgagttttcttatttgaaatttgaaaattatttgaaattgacttaactgacatcacctgttcccctctggatctcccagtgatttactgttgactctttcaaatccactcatctcagggctgggggactgagtcacagtctgctttttcctccattgtcatttccaaatttttcttccctctccttgctgggggctggtgctaagttgaccccatttttccctccttgtgctgtcactcactgcctttccagaatcttctgcatcaggtcagtcactctttccaacttaattccatatgtcaacccattcatcaccggagccacgtggtttccttcacacaaattgtcttctctgcaccacagatgccagtacactctggcccttgccatctgtccttaagatgcaacaccggtctgcttccaaaatccctagttcagacagcctgccttccagttgccacatcctgtttgtttcccagtttaactatgtcactgccactgctgcttctacttgtcagaccttcactgacctctccatttcccccatccctccatttcatccttacgttccttccggcccccatctctgcttcaacgaatgaacccgttttcatctgtttttccatgttgggattctagtcagatttccttgaaattaaagctttttctagtataaacactcagcctgtctctctcactttaaaagtgaagacatagacacacagagaagtgagatgatctttgtccaatattgattagtggtggaagtcccttgatagccaatccatatttctttcacagtaatagaaagtaccaaactttaaaaatgagattagaagttgcctttacataaatgtttaggcttttgagatctcagggctattttgtaatactctaattttaggaatcattgttacaatgtttcaaatctactgacttacacatatatatcctacatatattgtctaaacatattctgtagaagcaatggggattcatgattatgaaaaaagtggccattgctggtttaggcagtgtgtaaatgttgctactgacatcctaatgtgattttaattcttgcagtctggtgtcataaaatagctttcaaaaaagagcattttgatcacgactcattttccaatttctctcctccatgatcccaacatcttcctaagaaatccactctgtacctgagtttccacatggaacttaggacaatgatgttagtgaattagaggtctggcagaatcaaacgaaagtaatcctcaccaagtcactaaaccacactactttgagtctatgcaagttcaggaatttctatttgagcaaaagccacaaatggccagagcggacctcaggctttgtgcttgaactgcctaatgccatttgatttttcgatcccgcacttttccttgccagaccaatggtcttttctagcagtaaaatttcagaataggtaggctaccatcactctttgggttaccccagtgtttacttaagttgaaattcaaatagatatgtatttctatatgaatggctgccattctgctatgcccatgtttctgtttctcactcatctctggcttgtctcgtagagccctttctggtgctgacttatgttgctgagtcaaaggctttcatagtcaaagctcttctttttatctgatatgttttgcagtttgctgtactgcgtcaactctactgggatcatatttctcttgagactaactactaggcaacctgtgccttcttcctgcactgcattttgcaagtgcttcttaggatttcactttcatttaaaggcagtagatagctcagagaatgtggaacagtaactagaacagatccaagagctgtagaatcaaagaagagttaactactgtctctgaaacttagaatgtaaccaaagtcaagctatgcaacctcactaagcctgttttcccatatttaaaagtggattgtaatgtttatgagtctaccactacatcagattggtgcagtgattacaggagacagcgcatgtaaaactcctggcatggagcctgatgcatttgaaacatttactacaaactaccattgttgttatcattattaaaaataacccattctttcaaagaatcttgttcttggccaccaagcttggaagtcagtgatattgttcatcttatttgcccggtttttttttttttttttttttgagaataatttatgacctctgtggcagcaagtctggcctcatcttgaccattctatctgcatgtactaacttttcaattttaatggccctgtgagctttcctcccataagccaaaaagtgctgtttttctattctagtgttttcttgtcaggcaacaataatttctaaataacatgcctcttctaaaccaatctcttaaaaaatagattgtttttgtttctgaccctttctcattccatttcagaaactattttttctccttctttaagcaggttacaaacccttatatttttaatatgctgaggcttgtagtcaaaccattactgtcccaaaagaaaagcccttttagcacatttacagcttcttgctatctgtgccctaactaaattgtgctacagggatagtttcttaaccattaaaatgataggtgaacacaattttattttgaaggattactaagctatttttaaaatttctatagttagaaaagaaaaactgtttaactgaaacttgaacccaattaaaataacaattctcatggctctccgttttgcaatactttcctattcataaaataagaatgtgcactttacctttttgacccatatatttgatgtttttcaattctctacacgttctttatctctctgtcagtgtggaatattctgatttgttaattaatacccaaagcagcagttggctattaatgaaatgtacagaaaggtatttggtaaaggctacatgaagatgatgatgacaataacaaagatatctgattgaaagtaatctttacctgttaatcttcccttaatgtctccgactacaatggcagacgttgctttcttggatgatgactgaaagattagtttggaatgaataaatttatttttccatggttgattcatagatttttttagaaattactaattttgaaaattaaaccttctttttcagccttttgagttttatgtttctatagtttaggcttaaaaataatgtagacattagaaaaaaactcaagcggtattaatccttatatccctaatggtaaagagcgaggcagctaacaaatgaggtgctggaacactagcaagggagcctgtctctcttctggtccttttgttgtccaattacaggtgaaaagatgctatctgtcagcttgtcattaactcaaatacacaaaggcctgtcagttctcttatgcacttgccaatgtgagcacatcccatattgatgtttctactaaggcttgctgtacttgtaaacagtgtacttgtctggtaactaaatagggacaagcatgcagtaacagtgtgacactgagcatttcagttatatgtcttcttacctcagaattttaagaagaaacaatgctaaaggagattttttttaaaattaaaaacaaaaactacctttccagggtattttaaagaaagaaggtgaattccaattgcacatacatccggtatgtgtgacgccaggtttatccatggcctctctcgccctactgctttttaagtaatatgggaaatgcaaataacaaataaaaacctacttaaatagactagtaaaaaattgagcaataagggatcattgtataattagattagaatagtgattttgcaaagggttttaaaatgccttaacataggcactgacaaaatgtttgtaggtcttactaatgaatttttatgttttttcaatggaatgtgcattagaatgaggccattagttctttgtggttaaccaaaatctcaagatttcttgtaatgagagtaacttttctttctgggatccctgacaaaccggaagagagtgctgctgaaatgtgggaaaaacagctgtgttataacaggagctgccagccccccacacagctggctgcagagataattaattgtgaagagagtaaggaagtaattcacataattgtgtaaatgttaagtaatttacataattgggtatatatacaaatggatttcttccctaagctatttttttaaatacagaaaaatctaatctacaagcagttgattattaaggaaccaatttttaaataaaccaaaaaaagtatctattctaatgtgtgctatttttcacaaaaaaagtgttttcctgtgactgtatcctgcatcccttgttacaagtgtgtgtgcatgtgtttgtgtgtgtgtgtgtgtgtagataagtatatgatgtctttctgggactatatgcttaatctcactacaattacttttgggttattccatcagcaacacaagtaaatctctctagatactatttatctcaggagtgacaaatatgtgttaagaatgacttctattacccctgcattataagtttattttttccagtatttttttccctttgatttgagacttagcctaggcatcattcccaaagaagtgctccagacagccgccatgaatgaatcagaactggcccttggaaggaggcctacctgccggtcctctaatggacataacttacttttacctcacagtgttactcagtgctttatctactagggctcatgagatgcagtgttcatactgttttgtttccagaatccctgggtgtgttttattccctcagttgtatataacaggacgcacaatggggtcaggccaatattttttggctcttaaaaggactcttgctgaggtttgccagtacctgctgatctgcagctcccccagcttcataagcagtgataggagtactgagtcagccccaaattaaagaaccatgcatagaacaatgccctgcagcagactcgtaggacaaatctgaaagagcatccccagactcttgaggcatagatacctcctgaaaataagggtctgccttctataggtcattactttggaacatttaataaagcattaccaaaaagaaaaaatacatgtattttataccctcacatttctttttagtcatctttagttttgcttacagtctgattaccccctcactcccaaatccttagctccttacaaaaaggaaaaaaatattttctataacatatatctggaagttttaattttagatttatagtttcacattttcaagccagtatttttctagttccattttgctctatttctagatcattttttctctctcttttctcttaggttttgaaattgctttagatctttaaaaagccattcaccagatttttttttaacttggcctcaaatcatttttactaagtattttatttgagccatcttttttcttttttccatttgttttgttacttttctctccaccgaccctctgctatcaggcaagcatttatattttctattaagtatatagtttctcctaatctctataaacaattatgtgaaaataataagttaacaaatacaatatgacctcaattaactgtcttaatacaagtggaaatggcagagataattccaagagccaattttttattttaatgtgtttttcatatgtacattttaatgggagcttttatgatattatttttcagccacactatttcaaagaaaacaatggagggcattttgtggagatcaaattctggttgagctgtttggacacccagctgcccatcctttctctaatgctcctcccgagcacccagcatcatctctcagaattagacctgaactagccctgacctgaactgattcttctgtccctggtcttctctttctaaattatattttcttgatgagtattttctgtttctaaattagcatcctccttctgggcagtaaaattgagtgagtattagacaaaattgtgaaacgtgtaaacagacattgaatggtttaattaatcagcaagatgtgcagttgaacttgaaagtaaagcatgtgcataataatcctgaagatgattgaagattaattttagtatctgtgatcagataaagacacatttcaatgatgcaacaatgtttaacacttgcaggctactgcaacagaatacttctttagggtcctgaaatcattcttgctttccacaaacttagttgagtgcattaagagattctggctcatagactacttctgcttgttgactcatgccttatccttttcacaggatcactatctagctttaattaattaagtcaggctaatatttaaccagtcttaactactattgctcaccttgcttttctatctcgtgttcattgggcctgtcttagcaaaaaatgactatagaggcaatcaaaattttttatctgatcataagttcaaagttcaagtcagataatttaccttaaatctggattgaaaattaatcatatccccaaagttttggcttgagtaacagtctagatgtttttgtgtatttccttagattcaattctatcaatcctctcctgtgacacctgtaacattcctatagacgattcctgttcaatggtaactcttcacagtgtgtcaggaagagctcttagagatactattagtcagattattcaaataatttctttattgtatattcctatttggcaccaatttgatagtagcatttccttgtgtggatagtttccctttatctattaaaaaagcagtcttttctgactattttctattttcccagcctctactcccttgcttggaattgactgctgtgttaagagctatacaggtttacagaaactgatctttatgattcccaaaacacttggcttttgtgtgaaattgcaaaaattgaaatagcctctttggtacttggtacttattcaaaatgttctcatgtgtcttttggctgcattgcatgttgtgcacaggtaccctagaacttaaagtataataaaaaaaaaaagttctcgattttccaacactgatgatagttccgactttgcagattagcaagaacatgaataagattaattttgcataaatgtttttcatgtgcacaacttggagatcttcagaagaaagaagcaacgcgaatctcatacatataatctttccgtagcttctactgtaaattttggtgaagtgaaacaataaaatttgtataatgtagaaattaagggctgatgactgaatggtcattcactttaaattcatgtatttattgaaattattactcgagttcttggctagggatatagaggtgaacaaggcccaaacttgaaggagtgagtattgcactggagagagaatcatgcttacaaaatattagcaggcccatgttccttagtctctgaatttgtaacagaaaaacacaaattctttccaccctgagtcactcctatccatgaggaattgattgatttaactggcaagtggcaagaatttgacatcccttggttcaagccttccagtggggtaaaggtgtgcttagaagccatgagcacaggggatcttgttctctcatttcttattcccatcaccagctttccccagtagactggatgggtgagaaggaaggctcaattaattgcagaacaattgagtaagtgtcctccatgagcagtttcctcccagctgctgattctcaggaccaagatgaggggaataattagaaagcctgatcctggctgcaggtctctgccctgatgcagtggttgttaaagtaccagttaagtacagctcaagttgttcaactcagaaggcacaataagctttagcctaatactacagttctatagctttatggatggatacagggcaacggacacagcaggtgaagcatcttaatgtcatcagatgagacagaacccacccaggtacacagcttccattgcttcctcacagagtgtgtgcggccaccatggacaagaactaaacacctgggggtcactttaccacagagactctgtcctcagtttccaactagtctttcaaaactgttctggtttagatgcccaggtctctatgctaccctgcagctccccacccatgtgcagtgccaccaccaacaaggcagacatggcatgctgtattcttcttaactctgtagcttctaaactatgagtgctatgagaaggcaactctgagatggttcttcagcgtaggcctgggttagctcagacctgatgctaaccctttacttacaatgtccaatccagatttttcaacaataaagatattttttatttttattggatgcttttgtatgcttaacattttatctccaatgtatcacatgtgaaaggctctgtggagtcagttacactcctttctctctggggtaaggacagttgagatacattgattgcacccaattgacacgcagagaccagtagacatcagacttttttcatcttactaatgaggtaaattaattatgtcttcccgtgaagaggtctaaagtgatgctctagtgctattaccaatccaagagtggtatcagaagtctcctttcagaaattgagacaaagaaagaggacacctctattttaagaaaacaggtataatgctgtaatatatcactatccacagtgcagtgggatcccaagtgaaggtgtgtccaagtgtgcctggaggagatctgcttctcattgtagtgagaatttgagctgggatgataaggctctagtgaggtgagcagagagagggcattgcatgtaagggctcagtggatgccagaggggagctgggcaatatccaggagattgtgaagcatacaaaagactgggactttcccgccaaattcatacttacattattaaataagtacttgtcgtcatccaagttaattaattgatttatttagatttttgaaagcctttgaaattgtatataaagatagatactcaatctttacttaagaattccattgtgatctcaaaattctttgaactattctcttactcaacaaatatttattgaatggccactgtgtgtcaggcactagtctttctataaacataagggatgctgcagtgaacaagaccggaaaggtccctgctcacagaagggttacattctagagcttcactagcagtacagtggtacagtaaccaccagcatgtgtcgtgatggagcacttgaaacgtggccagttccagtggacatgtactagaagagcgacgttcacattggatttcaaggactttgtataaaagagaagaatgtaaaatatctcattaataaaatttttaatattgattacacatcaaagtgatagttgttgattgtattaggtaaaataaaatacacaactaaaatgtgttttgtttcttttacttgtggctactagaaaaattacataggtggcttgcctttctgctggacagtgctgctcttgaaagaagagtcaaaaaatgaactacttgacaaataaatgaacaagatgttttcccacagtgagaactgctatgaagacagtaaaactgggtgatgcaatggagagcgacagagactacgttaaatcaaccagccaaaggaggcttttctgaaatgcaattttgctgacatgaggatgataggcaggagccagccagatgaatttctgtgggaagagcagcattctagatagaaaaatagcaaaggtcccaaagaatggcttgttatcttaaaaaaaaaatggaagggttaagtagtaataagtctgaaggagagttgtatgagaggaaatcagaaaagtaggcagggctcaaggaacttgcagacttggaggtaagatgggatgtttttgaagtgcagccagaaactacagaagagttcctagcagaatgacaaaactgatttacatttttagaaagacctctctatctgtttcatgaggtaggagcagaaaaatgtgtaaagactgttctagtgttgaatcgcagacaagggttccagaggctgcttaaggctttcaaatggagcctctgggggaaaggagaggctgccaagctggtcgactcctctcttggctaaagctttgctgggcaagctctgtccttccctccattcttgcattctgcaggcagttggagataaactaaaagcatcactgttaatgttgtttttcaaagaatggaaaaaaaaagaatgcattataagcaggaaatcatgaaatgtgggggaaattgctttattggcccttggctggagtctacaaattggagcattatacaggaaggcattaaacagggggcgaaagggacatgagtttgattttattagccttaggtgagagatgaaactctttttaaagctccaagaacccctaggacctgagttgagaagagacacagcacaaagcagtacaaatctgctgaagcttcagataatcttgaaaagagtagaagacactgcagctctatagctagagaaaatcaagcctgctttgttaaaaacactgatttgtaaggatggctgtccattctgtaaaccagggtataactcttttacgtgacaagaccattaggaaaaatggcaattagatgagccaggatttcagcagtcagtctagctgaggaaagcgttttccatccctactgcttaccggccattttgggggaccatgatgactgtatgagacagccttagtttgagacagttgctggaacttgactgtcatatttgaagctgccaagcagtcaattgacaatgagttatcaggggctgcattgttttaggccacgtataaagctggattggacaggtatgcagagtggcttctactcacagctgggcagctgtggtttcagcagtccttgtaaaatgccttacttgggagaagagtcttcaaattagagtggtaaagatctatttagtagcaacattttaaacatcacatttgaacaagtattaaatatgccaaagttcagcatttcattcatggtctactctttccctctctactcactttttctaaaagctaagatattacattggtttaaaaaaggggaagttacataaaatataaataaaatgaaatataacaaattctagtataataaaaattctccttaaaaatcattacctccaatacaaagtgagattaatctatctaccttcactgtgaaaagtatatagaaaacaaaatttaaaaattacaatagttctactcatccaagatcataaaagcatgtttgtttcaatgaagagaattgtctgcatttacttggatgttcataaaactgggtttccctatctctaattctttgagtataaagtttaattatatatgccctttctaataacatataaataacaaaaagaaagtaaaatccatattatatcatatataaatagaccaatttttcgtcagtatcagattaaataaacagtagcctgtcattccaaaacacatgcacacacaaatcattatatacaatttgtgggaaacatttaaaatttatttataacgattgggaataaagaaatatgcaaagacatagggcaaatccaaaccaaaacaattcagcagtaacaatattaagattagacaaggggaaatgtcaagtttaaacaccaaaaaaaggtaaaatcagtggtgttagggcgttagctggtaccagcttgtaagagcctatggttaacatatcttcctaactccatgttcaataacatcatattgaaattggccacagtgtgattatttacaccgtagaaattggaaatgatacaaatcagggctttcttcctcccctcctctagagccaattgctaaccatttactagaacaccatgggatagaaatgatgaagttaaaattatttgaaatgcacatgtgctcaacaatatagcaactaaaactataagacaaaaactattagaaatgtaaggaaactttatttaaaacacatgattatactggcatattttagtttatttcttcagaattgtacacatccaaaaactattaagtaacaatataaataaattagatgtaatccataaacttagtaaatgaaatagacagtctttattcattcaatgtaagtgtgtaaatggatgtctccaccttaaaaatgagatattttaaataagccataattgattcaaaatggagttaccttttttggcatcactaacttagcgagtaatcttgtaatcttcctcttaaaatttgtttttgtgaaatcctaattttctatttctttttcttttgttgttgttgttgttgttgttgttgttgttgttgttgctgttgagacagaatcttgctctgtcactgaggctggagtgcagtggcacgatcaatgctcactgcaatctccgcctcctgggttcaagtgattctcctgcctcagcctcccaagtagctgggactacaggtgcccgccaccactcccagctagtttttgttatttttagtggagatggggtttcaccatgttggccaggattgtctcaaactcctgatctcaagtgatctgcccacctcggcctcccaaagtgctgggattacaggtgtgagccaatgtgcctggccctaattttcatttattatacttcccttactatagattcaatacaagggaatgaaagcttagacgttcttggcatattttatgaactcctataaaccccaaccaggttgtgagtagttatcgcttactgagaccttaaacacaaacaatattttaatgttcatttattatcctgaataagatacatagatatatattgggagttgagcgctaccatgtcaagaggagcaagcccatagaatgatttttctttcatttttttgcaaaacaactgcaatgtcccattaagacttttcctgcatgttcgtgtcagatgaaggaaagtattttccactgataccccaggttgttagctagtcccacgactgctcttcaagaaacacaagagacctatctgaatgtgggtaaaaggatttcatgttgctttttacttagaaacccagattgtttgtaataagctctgtctgattccttcaacacttagcatccaggcagttttcttcctctaaacttcaaaaaataggagagaattgtaaggaaaatgataaaagcatctgaagttcagcaaaagtgagcctcatctgagctgacttgtcctgatttggggatagcctgaggagagtgtgttcacgcaccttgcagagtagcccttagcagccacttgaataaaaacgaatgaaaagataaacaacaggagtgggcagaagttcgaaatggaggatgtgtgtgaagaaataataacattgtcttgaagattttagaaaatgggagaggcaagaaaaagaaacatagagatgaatcctggaaaaggtatttaaatcttggttgattgttcataaagcccccacccatagcatcttcatcatccctgtgggatgcaaatattgttgttttcatcttacacacacggacattgtgtttctgacaggccaaggggctgttcaaggtcaaatgactgttgaaggcaaaaccactagtatgcagcagtagcagaaaatgaatgcatggcttctgatgataaatcctatggtcttttcaaaacgcctctgttgtctctagggaaattgcctcaaattagaaatcaacacattctactgcagttctaatttgcacacgcttgcctgaaaactttctaatttctggttcttttttaccacctcctctcccacttaatttcatagctacagaggggaaagatagctactgtccaaatagtcttgctaaaggacctcattttcaaaattctttttcccccttcaagtcttcatttgactcacggtgtaatcacattagtgaggaagattttgtacagtcatacctagtgccaaatatcaagttttcctccaaaaagcaaaataaaatgatgggcagaccacctgctttccataaaattgtaccaaaatcaaggaggacaactctacgttatcacgtagaaataacatcagcatttatgagtaataggtctgtttgatgggcaatgctgtggtgtgtaaaattctgatgacaacatgttgaaaaaaaagtctggaagaatgggagaaaaaaagtgaaagtctatggaaagtagtagatttggagtccttttgaagaaaacatgcaagaagctgccagataactgctagataagcagctattgaccatttatgaactcagttttaccaggcgttgagaaggcgagaatactcaaaataaaacctgcatagattccacccttaggaaacttacagtctggcagattcaaaacaatttcacttcactttaagtaattgtaaaattgcctccataaaagcatagcctggatgaaaacatttttcaatattatttactcattttaatgcactcaaataaactttataccaagtaacttctttaaagatctaccaatataaggcacgtatagatcaaagtagacaatgtcagcccatataatccccttctccaggtccattttgattgcttgtgtcaacattggggaccacagtaaattactaatggtccttaaaattccccccctatttatctctttcttttcaatttttctccttcactcctgctactctatttcttgtgtttttttttttatctactttttttttttgctcttccccagggaaactagaggaaaattcttcatcctgataagagtttttggcaccagaaaggatattttacctgtagtctgacctacatggagtgagggagcctgaacatgtttccatgagtgttctagttcaatgggcagaaagatccatcaggagaaagcctttgtcactgatggctttgaaattgttcaaatgactttgcagttcacaacacgtgagcttaatcattggtttggctcttctgaggagctgagggagacaaagaagcaaagttattttcccagaggtagtgaggcccaagatgctcagaaaagatttaattgaaagatgccattgctgaaatttcttttataatgttctgcctgtggctttccaatagtaatagtagtagcagttgttgtaataatagagatagtagttgtattgatagcaataataatagctactatttattgagcactgactgtgtttcaggcatgggtccatgcactttacatatattaactcatttaaacctcccaacaacctaacaaggtaaagatgattattatcccatttcacaactgagcaaactgggacatgagatttaaggaacgtgcccaagctcacacagctaggcgatcaccaattatacatttcctctctgcaagagaacagtctatttttcaaaaacatgctgataaaacagcaatcccatttgcttctaaggacaaaccctgccatgcctgagtgttgccattcttaaactccaggccagggcttgcctttggatacatgtgagcttcactgggctctctgctcaatgtccctcctcagagtgtctccctaaccacctctcttgatctctctccacccctttattccacttgggttttcttcagcacacttagggctacctgacagtgttagcaaggctacaaagcaaaacaccagatggggtggcttaaataacaatcatttattttctcacagttctggaggctggaagcttgagatcagtgtgccagcttggttcagtgctggttatgggtctcttcttggcctgcagacacagacaccttttcactatgtcctcacatggcctttctgtgtgtgtgtgggggggggtgtgggtgtgtgcgcgcgcgcgcgtgcctgcatgcctgtgtagggagaaagagaaagctctttgcctcttcttataaggtcagattaggaccctacccttatgaccacatttaaacttatttactgactaaaagccctatcttcagatatagtgacattgagagttcaacatatgaacatatgagctgataggaatatatgaattgatgggaacatatcaacacttcaacatatgaattggggtgagggacgcaatacagtccatagtggtgacccagcatatatttaataggtcattaatgtgtttactatgtgtctttcccactcctcccggtattagtaatctaaataccagtaaggatttgaggttcttctttgttgtattcctaatacctaagacactgtcccacacatggtagatgttcaatacatatttgttggataaataaaaaatacagagctccctcttctcccctacatgttggaaaatgtgtgtgatctaaatgagggagagggagaaccatctcatctaatcttccaaacttcctgagccacctttagctactgagcacattcacgtttccgtcagctgggaatttaggtgccctgcctatcatcctctggagcccatcccaggagggggcagaaggaggtggagcagcacactagtgttcccagagtggggagagcagatggagaggagttcatgggaacgatgatttacccctgctcacttacccctgtgagaggacactgccctccacgaatcaatgctggctcctcctccaggaaccaggcttctgcatctcacttgccatgctgtggatctaggaacaaatttgcatttggaaattcattttaaagtgtgcatgctgaggttctggtgacatgcagggtaacttctcccacccacgatatctcttgactcaggccttcatgtaggaggggaggagtgtttggcagcaaaactgggtatttcttaggaaggaaatccttctaagctttatggaaatcctagggtgttgtccctacctttctgagtgtggagcagactatctgtgtacatagcggtagtgaggggtgtaatattggagaatggcttaggtaacagccaaaatatacattgtatatccccaaaaagacgaccaaagactcacaggccatgctgctatcattagatataataggcatagcctttcattgatatgtaaatgttagtatttttggtaagtgccttattttatcttctggataatataagatacaagtaccatgagggcaggatccttctctcattcattttttttcccaagagcatagcacaaagtaggaagtacttgttgagcgaatgaatgatcctaaatatgaaaggatggcattttatcgccattttccagatgagaaaaaaacgagggagcttatcaggtttatatatagtgagtgacaaacttcagaattaaaccaaaatctagtaattcctataacttacaggttattaaggagtccacctgaatgtaagtccaacaagacaggtgtttattttgtttacatacattccaagtacctaagacaatgcctaacatatataaaatacttcataaacatcttcatgtgtgaatagaattttcaaagttcatctcaatatatgcctcatgtgacacttccaacccttcactgccaggtctttcagtctttatttgaataggttcagtaagaaagaattcactcgtgctttagatatgtatggcttttccacattgttgtcagttctaaatcccgaaagttatttttgtatgcttggaatacttcacaatattcacaatttttacaataaaataatttcaggtcttcttgatgaaaaatgtcgatcaggacagggctgaggataatcacaaggcttgaaattaaagaagtctccttaggctgaaatgaatttctagttgtaaaaccaaatatgaatctatgtatttgtgttcctcagaccacttttccagcaggtccttggctgtattttgtatgcatttgtgaaatgctttgttgaaattcagtttcagccaggtctgtagcattctcctggcccctggtctgatagttgtaccaggaacactagctaacaattgcatggcactagtctcagctggatttgttctaactcttttatatgtattaactcaatccctacaaccaccccatttcattactatgcccacttgagaactaaaaacactgaggaagagcgaagttaagtaacttgcagaggtctcagagctaggaagtaagacagccaactcggaacccagcagactagctctggagcctacccacctaccctccacaccgtacctgtggtccatcctcaccaaccaggcctgctgccctgagcataacttcaccctcttgcgttctaaaactatctgctgattaagtgagttctgaaatgttttcagggaccaatactaaaatcaactatgaaatagtttcagagattgacctttcctccttttggaatggataagattttcccaaccgaggtctcccatcagctctcctgttcccctggactgtggcacataggagggccagggacttgcgcctattatttcatttcttttgttatccttcatttctagatctcttctctaccacaattatctctcatgttgacagtttccccacagatgggatgtctatttccttgataatacagcattattatgctaaaatctctcatttgtgttattagccagactctgtgcaaaaacgtgtgtatatctgagactctgtgctgttcttagccaccttcttggtcccttctcatgtaaattactagggcacttcttcaatattattattatcatgcccccttaccaccaccacaaaatcttccatcataacccatttttttttcctcctccttaccacattttcagctttgaactcttataatcagatcaggaattacatttctgaacaaatgcaggctttgcagcattgtgaagtgcagctggtccccagcagagagccctaagcccctgcctgaagccaaacccccttttgtggcgagaggtctggattttatttgttgtttttatctttggtgaactgtcaactggaagcagagatgcgaacaccagttatgtcctcccctgcaaggttcatgaccaatactttatagtttctggatatgcttcctaggtttcttctgttggtgtcatttgcctgcatgtgactcactggcaggtggtgatttcatcatattctagacatgtgtcttaggaagctggcccctatcctggctggctggacacatatcgaagttccttagatctaccattgtcactttcatatccattgttaaatactatagatagcatgcaggggtcagccaaattgttctgtaaaaggctcaagcataaatattttaagttttgtgggacagacagtctctgtcgcaactacttgactgatgcagcatgcaagcagccacagacaataagtaaacaaatgggaatggttgtgtcccaataaagctttatttataaaaactgtctttttttataaataaaggagcccatcgtttgccgccccctagtgccaggaaggaacaaggggaaaataaggaagagacccagaggaaaaaaagtgtcaccaaccatatctctaactcatatttatttacttatttttctaagcgcaatcgctaaattatctcgtcttcctaaggcgtatgaatctcttacattaacttagggacagaatatagagttttatgttatcttctgtgagttctttttccattctgtcatgtttcagactttcagaggtaatttttaagtatttcagctgtgccttagatacattaagggacctatagtgcctccctgaggccaagatgatggttgcaatcataaataggttatttctgagttgagactggtaagaacagattatcctgcccagacagtgatgtgccaagcattggcaactttgaaaaatttgcaatttgattttataggagagtttccttaacaggcctgagtttttttcccattgcttttgtgaatacagtattttcccctgctagactcttagtcaaatgttcttgccattataagaaaaaaggaaaactgaaaaacttgaaaataattttattggcttaggaattattttcatgtttgtctgctaatggcaaataaatctaccttattgaatcatacggattttaattccccgggggaaaggtaaccaatgacaggcatatgtgtgtgtgtgtgtgtgtgtgtgtgtgtgtgtgtgtacaagtgtatgcttgtgaaaattgaacagcaaaaagaaattaggtggagaggaaaacattaaagctggtactggtgggtaatcattatatatagtatatatacacatatgccttctccagttttatggaggcagtcagtgcctcaaagacgtgtaataaagagacagcaacaattattggtggcattcatgtaggagaggcttgagccaatgtaaacttgacttggttagtaatctttgccaaaactccctgattgttgtaagggagttgtgaaccattaggtttgcttaaccagaacagcaagtaagcatccaaacagattgtccttggaccataagcaaatgcccagaaaatagccccctgcataggatattaagtacttagaaacaaatgagaaaaaatattacagcaagtcttccaggtatagaagggataaacaaccctattggtatcagaatttaggaatattattatgtctcccactttaaatgaaatacagcagcctgacttggcaaaatttggggaacggttccccttctttgcagccaggttcggtgcttgccctctggcatcccttcaattgtgtatattactggcagagacagctgtttgagctgctaataagattgcaaaataatatcagcttgtgcttcaggttgaagataagagataacattgcattggctgtaggaatggctttcttataaactggatttagttttatctcacttgtctcacttgttacttttttatttatttacttttttttttttgagatggagtctcactttgtcacctgggctggagtacagtgacacgatcttggctcactgcaacgtccgcctcccaggttcaagccattctcctgcctcagcctcccaagtagctgggattacaggcatgcgccaccacgcctggctaatttctgtatttttagtagagacagggtttcaccatgttggccaggctggtctcaaactcctgacctcaggtgatccgtctgcctcggcctcccaaagtgctgggatttcagattacaggtgccatgacgcctggccccacttgatacatttgagggtctcataaggtcttgaaattgagcctgtgaatttataaacagggctacaaccatcctgcagatgcaactttttggcatgccagaatcagtggcacctgaagagcatctccttgaaagcggtagtagataaaaggagatgcctttcaggtttcagacgtggacctcagattcacctccaagactagagttatcacagtgcacaggatcatccaagaacagacatgcagagggaggaaaggccattgtaaggctcaggagaacatagtagagcctaaaaatgagaacaaaatggtactatcagaaaagatggcagtggttgggacataagagagggtaggttcacaggtttgtgggaccaggactcagtcactttcctcgcgctaggctcaaccctcacgatggggaaagtaatgtacttctgggcttaaaattcttcacagtcaactggtagagatatgagggaatttattgctaagtagtagggaaagtgttttcacaaataacatacaggaaattcccatatcatacaaaggaggttgtattatcaccacgtttttacatatgagaaaatagagtcttagaaaagttatgtaccttgcctaggagcatgtgcctagatagtggcagctccaagattcaaacctaaaactccagagtctgaaactcacacagtttcttctctgttctgaggcttcatgcagctggacaggaggttagcctgagacaagaggaggatcattctcgaaggcagagaggctggggacatgactgctttctggaaacctgagctcatggagagaggctgagagtcaggaaagtaggacatgaaatcatttaatgagagtgaagaccagccaggtcagggagtttgaaaagagagttttgaaatatccattgtagctaatatgggagagcattctttgagagtgattaaaatggcgactgaggacacagctaaagtgagaaagaataaatctgtggcagacttgcatatttttggtatgtgcatctctttccgaaatcaattgaacagaggtgggaaaagtagcttggtggataatgaggtagagtggaaagttgaaaagacagagcttaggagtctttctgattggtctaaaattccccagggaaaatcatgtttctttttatgaatatagtccaggtcttaggtctgtcccacggcacaaagttttcaggacattctggacaaattcacacatttccctggatgtcagtcaattccctttgcctctgtgctatcactttccttctctctgctttctccttgagttacctgtcccagctcttcactccacattctgcagcctccgtttagctcctttatacctttgtccagattcttcctaacttattatactgcctcctcatgtcaacttccatcccatctgcatttgggaaaagaagcccacatgataagtgagtccatctgctaaatgtatgcatcttagagcatttgttcaagatcaataaagatacaaattattttgatttttcagctgttgcccaaatccacaagagtacacaaatgaaaatgcactgatttttaaaaagtacaaatagccattaaagtttgtattgttttattctttaaataagccggaaaaatgggaatacgtaggaacgagggagctagcaaaataggcggggcttctgcgtttcaggtggtctgagactgcagtgaccctgaggctggtggacctggaaggagccagggagagatggtggatcccaggggtgggagcaaatgcatggtccaaggttctgaatggcagagctagaccaaaggactaacctgctaaccttgaccaaggagatggcccagaggttttctatttctactgctccatcttttcattataagttcccagtagaaacgagtcatcatttaaaatatcggtgcagcacttaacacataaggaaaaatcaataacattcatttacttacagtacccagagaagaaataaattcaaatacgtaaaaatgggcatgaaccatcctgttccatatcccactttaggactgtcagcaactgtatacattgctgaacgtcattgctcttgtacataatgaataattttctgtaaccctgtgaaggccgactgatttttacggaaagacagctttgtgttaggcggcccgccttccccacggaatcgggttttcccacgccacgttttgatgtttctgagaagtgtgcgccatctgctggccgctgagaggattgacgagcagccataaggagcaccgtgtttcttgagcatgacttaaccaggcaatggaattacaattatctttgggtttctaaaacataatagacatttcaggattcacgtgacttatgagaagtcgcttaattgcctttcaagcagtatacattttttattcaatatgtgtattattctttgtaataataaacgatgcaataaagcaatcgaggggttcccacatgctctctaggcagagatggaccccgggccctagatgaaaggttaatagtttggagtgagcactaactctggtcctctgactctgaatctaagtcaggagtagaatagagctgtacaaagaagactgcttgatggaattgaattttgtcccttcttcaatgggggaaaataaagtacagttttcatcaatagattaatgactaaacttggaccttgatgccaaatccaacttgagctccgcctgcacagtctggagatgtacataagagacacatgctcagcctcttagcacatcgttataatccaggcaggcaatactatatcctaaaattactcctctttgctgaaattgagaaaataggaattacccagggtaaatttggtacataaatgtaccaaatggtatgatttattctagtactgtcttctttttcttgattttcttctttattgggaaatttgtattttgtagttccttcgacactttaaaaattaaactagagggtaagatttaagttttctcacaactaacaaatgattttgattttattgcccaaagccctttatatctcactttcgatgggtctagtccctttggcttaatttagatgtgatttttccttaataattttgaaaatggtggtgctctataccaactagctagaataggaatcacattgacagtatttaatggatagaagcatctcaaagatctttgcttaatgagggcaaatcattagcaatgtccaactccctatgttagaggcgccaactaaggcacggtacttaaatttaaagcacaactcttcgacttccataaagtacatatattacattatatttttaaattacggggtagtgactcgatatgtcactggaatgttttgaatagtgcccccggcccccctgccaaaaaaaagaatgcaagaacactgtcctaaccaagaaggcctgggagttttaactaattcagcctttcagcctccacttaaaattctggaagacagtagtgttggtgctagctgtccttggctgcaagttgtctttacagaagaacttggggtacattttggtgtgaggccactcttgcaagcagcatttgcaggcattaagagaatgcacacagttcaataagctggggttatattcataatcagtctttgtttaatgctgtaaaaatactaaaggaatggccaaaatctctcggtatctggggaaaagggttctttgaaacttttgatgtgtgagcagaataatggaaacttatctgttccccatgcttttaacacacacacaaacacacacacacacacacaaacgtcatagatcaagatgtaacaggttggaatggggcctaggcttgggaattttgtgactccccaggtgatctcaatgtactgctggtttattagcaggctttgcccaaacaaatactctttctcacctaccaggagaaatcaaagagctctgggttaaacacttgtatgttaaaaccaaaatggtgggcattgcagagtagaggaattaggagaagaaaatagatattgggtcaaaaattggcctcaggaaccaggaagtaagaatggccaatcttaaaagagaaagttctgttgaagagggagcattatctgaagttggaatgactatggaggacaatgacagctgtcccacaggatgtcactgggctgaggaaaatcagactggaagccacaagcccatgggggctcaggaagcctgtttcctgagcagaacagagctgggtttggcacatgcctagtgttccagtgaaatctgtcatttttctgcttccactttttacaaatgagttattcaacgctactttgttgacacatggactcagcatttaaaaaatgacagtggagataagggtctaaggtagtgataggcaaatgaatgatgggcatccatcatctgaagagcttcttaaaattcagatttcccaaccccaccacagacgtctgtctccgtaggtcttgggtagggctcagagcaggctgcttctgaaattttgaggttgtgaggtaagaatacaggtgggagcctgcataccacttgtctaaatatttaaaagttgtaaatcagcctaatgaactgtgaaggaagctctggcctacttccttgacaacttaagcctatacagagacctggaagatcaagttcaaatgcagaacctgaatgtttcggttctatctgctccctcagtgttaaaggtctgtcctttttccttgacaaatatgctttcataattgtctggaaggccggattccaattcagcaattccaatccctcagtgttgagggaaagggccacccgctctgctcttctcttcccatctggctctgtctggaaccacgaagcacctctgtgtgtgtgtggggacaagccagcccaggtgcctgcgttttggcccagtacctcctaccctcatactacatatgtagccacccccaggcatagggttgtgcacactggtgacatgtctgccctctagaagaagcatgggggaaatgggaccccacaggccctgttagctgatacgggccatgagctcccaggtcacggtctaaaagtacattggtttggggctctgcgtgaccatattccaaggatcctgcaaaggaagaggcaggactggagaagggaaagagtgggccttctaaggctcccagggcaggacctctttttgtctggtctaagaggggtattgaacccaagtggcttagatgctgaatccctgggcttagaacccaatgccctggagcattgatctcacagtgctggccagaaaggggctcgttggttgctactaggtcattatcactcccagggcacctgggcagtcaatgaaactgagctcagaaaagtcctgcctttatgatgtcccttccacttccataactttctccataaaataaaaccaagaaaaataatttttctcttgatttcaaatcgtatttaaaggaaaatagaaattttatttttaaagaaattgcatgttttcattgtctatatattgttttgaaatatgtacacgttgtgtaatggctaaattgagctaattaaatgtataacctcacatgcttatcatttttgtggtgaaaacacttaaaatccactctcttaacaattttcaaaaatatttgaaaaaatatagttattaactgtagtcctgtaactatttcctattaattatagggaagtagaaattttaatagtcatctttctcatgcttttcttgacttttagattcaagaaataataaacttgaataaaagagattaatttcacagtaatgcaatatttctgtaaaatttcacaccttgttgactgtcaatcagctgagaactttacacctcattaaaaatccattagaacaatggctgttccattagcccttcagtttatgccttaaaacatacttgtctaaaaacaacattgtttttggcaggctgctccttttgataagtggggacttgctctggtattaactgtttccaggtctccagaaaaaggctcagggtatgtctagggacatcagtgacaacagtgaggtagagcaagtcaatactgtgccacctctgcgctagccagagaacctctgctccaaggtgagttggttccccctttcattaaggtcctcaggccccagtaaaatccagatatggctttggagaggaacgctgtctgagtgaagctccctcagtttcataaccagcttagagcttctcagctctgacctgcctgttagcatggctggggagcccagtggtttattgaactggctaataacaaagattctgagataacgaaacagaaaacaggtaggttttgatgaaaaggaaggagataaggaggataagaggggtagtagggaggaatagtgggagaggggcaaagaagcattaaatcaagatttggagaatggctggaaacagtggcagagactcaataggagagtgaccctgacagacggggaggtggcaaaagtgcttgcaggcacaggccacccaacagttatttcggggactgttcacaatctcatctacttcacagttttgccttgtcctaactcaggtcttattagagccagaataaattgccttgcatcgtcagaaactgaccattcattcctgtggtcttctttgagatttttagaatcccaaggactaaatatccctatccacttgcctttgttcactgtattggatgatgtgccattgcctgtctccagcattcactgagagcagtaccccaacatccaacacatctttaaatgccaaagggaagtgaaaatgtcctgacttcttaaactctaacatagcattcatcctattcttatattttttgaactttgcatcaaaacatacataaatgcaggtgcacaaattgtaagtgtaaaagtcaatgaattttcactaagtgaacacacttggctcaccagaagctaaagaaagggtgaactagaaggggactttgtagattacacttcctgacaccatcattatttaagaaagaactgtttcctaggtatattttaggaccttttatctggtgatatctatctactaactttaggggtggggtggaattgattctttttacaagattagtgaagctagaaacaactagcttttaattcattaaatgtaacctactttcaagtagcttcatgtgactgaaatcaatctgttttattttccaaaccagtggaatacacacagggtcattacatacattttgaaagtcttctgtttcaaatgtattgtagattaagaaacagaatgtggcagggcacggtggctcatgcctgtaatctcagcactttgggagaccgaggcgggtggatcacttgaggtcaggaatttgagatcagcctggccaacatggtgaaaccccgtctctactaaaaatacaaaaaattagccaggcatggtggtgtgcgcctgtagtcccagctacttgggaagctgaggtgggagaatcgcttgaacctgggaggcagaggttgcagtgagctgagatcatgtcattgcactccagcctgggtgacagagcgagattttgtctcaaaagaaaaaacaaaaaatagaaaaagaaacaacgctattggcacacccagaataatcactattggacttctgataccaaaaacaagggggatttcctcgtttttaagttttatgaaatgaagtaatattctgtatactcttccgagtttagcttctttgagtaggtttgtgagatttatccaagtgtggaatggagttataatttattcatttttggttttgggtgattgtatttttaaaattaaggtaaacattaaaagttagggtttaacccactactgggtattcacccaaagggaaagaagtcattctacgagaaagaccacatgcacaggcctgtccaattcacagttgcaaaaataggcaaccaaacttgttgcccatcgaccaacgagtggataaagaaaatgtggtatatatgccctatggattactactcagtcataaaaagaaaccaaataatgtctctggcagcaacttggctggaagtggaggccatttattctaagagacgtaactcaggaatggaaaaccaaatatcatgttttcacttacaagtgggagctaagcgctgaggatacaaaggcataagaatgaataatggactttggggatgggggagagattgggagaagttgagaaataaaagactacatattgggtacagtgtacactgctccggtgatggatgcaccaaaatatcagaaatcaccactaatgaatgtgtccaagtaaacaaaacccactgtaccccaaaaactatagaaatagaaaatgaataaataaaagttagggattaaaaagaaagtgggacatggtcattccagaagtctaaaatattataagctatatataaaatacaagtttgtaactattttttgagtacctgcaatcagcaagtttgcattaatattactgtttactccctcactttttaaaacaactaattttctatttcctattttaagaccttacctaagattgctgtcctgtggaatggttcctagcccacgtgaccttgtctgtgttgaagcatgagtgaatacatactaccatctactttagtgaatgttgatgataaaatggccaatttcatgtatttgtttattttcaagaaaaccttagagcactcgttctcaaactttaggatgcatcagaattacctggagtgccagaatcccctgaagtggttgtaagaactcattgctggggccaggtgcggtggctcacacctgtaatcccagcactttcggaggccaaggcaggcggatcacttgaggtcaggaattcgagaccagcctggccaccatggtgaaaccccttctctactaaaaatacaaagattagctgtgcgtgatggcgggcacctgtaatcccagccacttgggaggctgaggcaggagaatcgcttgaacccggggggcggaggttgcagtgagccaagatggcgccactgcactccagcctgggtggcagagacaaattgaaaaaaaaaaaaaaaaggagtttctaggccccatccccagaatttttgattttgtaggtctgcggtgggatccaattatgtaccgtctaatgagctcccaggtgatagtgacgctgcagacctggctccacattctgagaaccactgccttagagcctgcacatcaagtcacgtttatattcctgtgccgtactcccctggtgaggattcctctggtcattcatgcatttacgtttttaaactccttggaatcaaccaggtagagattgtactcttgttgtcgtatttaccatcctaaatcattagcatctattatcttcctctgccctacaccacaactctgcttgtaacccatttggagcgtgttttctatgttcttgctttgtttacatattggtggccccaactatttatcagcttattaaagacatcaggccactatttgtctatatccctgcactgcctagcagggagcactgcagggactattgaattcatgcactgtattctctgctggcccattgatttcatccttatagcccctgcttctcacctgcatgtgtttttttcacaatttacatactgataaaatgaattcttgcttcttgctcatgtaagaatatggaggctgggcacagtggctcacacctgtgatcccaacactttgggaggccgaggcaggcagatcatgaggtcaggagatcgagaccatcctggctaacatggtgaaaccccctctctactaaaaatacaaaaattagctgagcgtggtggtttgcacctgtaatcccagctatttgggaggctgaggcaggagaatcgcttgaacctgggaggtagaggttgcagtgagctgagatcacgccactgcacttcagcctgggcaacagagtgagactctgtctcaaaaaaaaaaaaaaaaaaaagaatatggaagttataaaaataatctgtgatcatataatgactgttttccccaaaaagggcattactttcctgcttcaaagtatgtatttcttaactaaagtgtttgtgggatatggctgcgtgttggcatcacctagagaactttaaaaaaaaaatgaaaacaaaaacaaaacaaaacaaaaaactgatcttcatgtcccagaggttctcttctaattgatgtgggctgtgatctgggcatagagattgccaaaattaccccggtgattctaacacataaaaatgttttagagtttcttaagtactttttttcctgatgagtttcaagagggccactttttttttctggaagattattttcagaaacacctagcccttctttatttgtatctcctgtagatgttttccttctgagtttttctctgtgaaacaagaaaatataatgaactgtcatttgcacgttgcacaaagcatgaactttatttggagtcttagataaacttgttctgatctagaaatgaaaaataatgaactctgctgagttctgcatttcctgtctgaagttagctttaccataaggatctggtgggtaagtgtttgttgttcttgtcattaattattggaacagagttgtttggagtagatgattcattgtggaacaaatcgtctgattttgagggacattttccattataaaataattatacataaaaacagaagtattgctttaatactaagatttgtaacaatgccatgtcattctggttgtaatgactctgtgtctattccactggtttggaaaataaaacagattgatttcagtcatatgaagatacttgaaaataggttacatttaatcaattagaaactagttgtttctaacttcactaatcttgtaaaaagaattaattccaccccactcctaaagttagtagatagatagatatcaccagataagttcctaaaatatacctaggaaatagctctttctcaaataatgatggtgtcagtaagtctaatgtaagtccattttattttaccctttctttaggttctgcccttgtatcttagaataatgaaatatgaagtgaaatttggtgtcatggtttacctgtagccattttataatttagattcatgggtttacattacttactgaaactactggggaaacattaacaacacaataggattcctagattgataaacttcaacactcaagctatgacagttgttctcagtctcgtctttgattcaatgtaaaaatttggacaagttaattagctttcttttgctgcgtgtataggggcaggataaacttgagaattcccacaattattcaacccagatcaaagatatttgtctcaggaaatcaacaatattaagaaaaatggctttttgaaaaaaaattaaaaaaatgtttagcaccttcaaatatcagattcacatcctcatcatcctcacttagagattttaaaactaatagcaattttgtatggcacatttgcatttacaatgcatttttgtacacattctattttcccctaaacccagggagactggaagagcaacaatttacatatttgcgtatttttagaaagtgagtcttagaaaggttaagtgactaacctaggctcaaacagccagaagtgtgtggaacaaaggcaccacacagctttgctgactgtgagctcactctttctactcctccagctatgccagctatacaatagcaacttgtgagaggtgttaggtgtgagggatagtaggggggtaggggtggggaggggaagaggaagcaaagtcctcatactgattgtatttttatcacttttctaaaggattttatgttttacagcctatttgtcattggtggaaatatctctacactggtgctataaacagcaaaacatgcacttgagactccctgcaagcccatctaagttttaagggtaattgagaatagcagcacttgatacacatatcttcatttactatatagtgtgatcaattattttccctgatactaagggaaaattaaacatcttttcattggttgttgcatttctttcacggtgtttttaatgcactttgcgagcttttgtagttctcaaaactggccactagatggtagtgtttagttagtattgtcgcacatgttccattgtgggaactttgattctaataggaaacatttcatatataatactgcactgaaactgtttccccagtggctgaggcacacgataaaaactctgtggcttgagccttctttttcttttttaatgactagacctcccttcattcaacacagacctttcttccacatactacttattcagcaattcatttttctccccataatagtctttttaaacaccccacagtgagggagtgttaaaagtcctgcctttcgtagaattttgctctaaacttctgagaggtaaagcagatctggtgccaagatgatgtgttctagggaagtacaaggacaatagacttaaagacctgtgctgccagcttgtgaataattgaagatttgtatctcgaagtaaatttcagagtacccctgtacttccttgggtatctaaaccaaataagacagaagttgtagttgcctggtatagataccacattgccaaaattttacagtattttggacaatccaatagatgtcttctctctgctttgtttaagccttctaatttccccagcaagacaaagcaaaacaaaattaattcacacagcctgtttgcatgatatggtccgatggtttactatgctatgtttgtcattagtcacccaagcacagaatctaaaagtcacttataaccatttcctgcccccccatgactgctgattcttccaaaaccataaatctcctttactaattcacttgaataaccaaacctgcatttcaggttctcattctttacacacccaataaaaaatgagatgccatctgttattttattcattaagtcaagttctgtttctcatgttctgcgggaattcttcccatgtggttttactgtttgtttcactttcttcaatttccctcatcattacacataagcatttataaaatacctcttcataaaatccactccagtcattctctgcagttaactccaagatctccaagatcaaaacagaccccaaagttgtcaatgaaactgttcacttgcacagtgcaggggctgggggtgtggttacttgggtgtgtgaatatgaactttcggttgtctgaggacaacaggaagccttgtttctggttgctatcatattaaactttagttaagatttttattgtttatgagatagggaattttttcccctgggggtcaactggggtcaccctatttcctgagggctaaataaaattggctgcaatccccatcgtacagattgtgaaaagttctgctttctctccaaagcttttatgaatccttgatcacaccaggccccacatctctgcttcagccaaattggttgcgtttaggagttctctcacagtagctgtcatcatctcttttttccataccacagaggctcaaggtagaactgagccccttccttagttttcccaaccaccagccttccctctgccccaacaaaacaaaacttgttcacacatgggatttctgcattgtaccacactttactgatggtttgaagaaatggaagcaatgttcaccataatgtgagaagtgactgtgtttagactttcatattcttaaaaagtcagttacccagtgatttctatatggaaggtgttagccttttgctaggtttgcttgggttttttctttcattcctacccttccgtacctctcctacttcaaaaattgcttataggaactccagatttttcttacttaatggcatttagtgctttacgtctctcctgctccatccaccttttaactcccagaactacgcaagtgctcagcagaacaaaatgggctttcatgtaatattaccacaacttgatagaagatatttttggttataaatagcttttaaaaaaaattttttggtgattacatgtgggtacgatgactaaattgaattttgctcttcgtctcatacacacaaacacacacacacacacacacacacacacacacacacacacacaggcatttatatatagagagagagagatggagacttgttctgtcatcccagctggagtgtagtggtgcaatcacagctcactgcagcctcaacctcccaggtgcaagtgatcctcctgcttcagcctcccatgtagctgggattacaggtgcgggccaccacacctggctattttttattattttttgtagatgcggaatctccctatgttgcccaggctagtaactcctaggtgtaagtgatcctccagactcggactcccaaagtgctgggattacaagtgcaagcccccatacccccagccttctgctcctatttgacctagaaattccatatagtagccatagcattcattcattcaacaaataattattgaacacctacttgcaaaaaggaattcagttcctattctgttggggtgataatctagtaaataataataataataatgaaaagtgtccatgcactcttctaggctccaataatccctatgaagagagggtatgcttaaacaacagatgcttattttctcacggttgtggaggctggcagtgtgagatcggggtgcctgcatagtggagttctagtgagggctggcttcccctatgccttcacccaaagtttatgtgttattaatatcagcagccctctatctctggatgtctctggtgccttagaagacatattctctacagttaaagagtgatcctcaagaacggacagggtaaatatattttatattgctaaatgcccccatttgaagggctatataccatttcatgtagcaaggagcacttaatggctccagcagaacaaaataactctacagaaaatttttatttgcccaaagcatctaacgagctggtccttccatgcatgtggtggcactcttgtgaactgcttcctgagatcctcttagtgcaaagccaacaacattcagtacatttccttcacttgccttttggcatgtccatgacaatatttccagctgatctaacttctagaaaatctatttcccacaagcaacaggtcttctattttcctgcttaagagtgtttatttttgcttttttcagcagcttcacaacttctgacttggttgacttttttttttttttttttagagagaatgtctctcctccatctgcgaagtgctgcattttaggtttgatctgacaatttgatgcaacggctcaggtatatatgacaaggaaatggaatttctatcctcgaaatcaattctgaacaataaaagctgagaggataagtttattcaaaggtgatttggtattgcgacaggctgctccaaatcagaactcagcaacctgattttgaaaaatttccaagttcatgaaaagaatcactttgtacataagggctttctacttgtttgggtttgagcataactagatagcttagtgggatatccatattcttgcatttgatgatcacatttggcatctaaatattatgctgttttcaaatgaaagaaatactgctgaataagagagctagaatgaattacatacaaagaaaacttaaaataagtgtcatctaagaagatgaaaaagcaaacaagtacatatgttcttaacttttgggggcttgcctttaatttttttaataaggcaattatctgctattagtaattataataggagctaaaatccagttaatagtcactgtgtgtgaaaccctgtgctgagcaccccagggtatggcctccaagaggacacacaacactctttttggagaaagctgaagacagtgggggcagtgactgaaggtcacggagttggtaaaaggcagagccaagctcaaacccacacagccacatacctgcaactgtgttgttagcactgcactccccagttaccaaagccttgtttattttccagtcctaaactctgcttaaatgtgcatgaagagtaatttcattttttttccttttctagactgtaaatttgtataattggatttctacaggcttttgtgtttctggtgagattcaaaatggatttttcaaagttacgatattcagtgactcctataatctagaaatttctcccaagacaccagacttcctccctgatcttttgactaaaagcctggtccccagctgtattcatttcctagggctgctgtaaggaagtatcacaacctaggtggcttacaacagccaaaatgcattgtctcacagttctggaggccagaaatccaaaagtaatgtgttgtcaaggttgtttccttctgagaaccgtgaggcaaggatttgttccaggcctctctccttggatagccgtcttctctctttgtttcttcatagtgccttcctcctgcatatgtgtgtgtctgcatttccccattttataagaattcccctcacatcagataaggcccactctaatgaccttattttaactcgattacctctctaaagaccctatttccaagcaaagtccctttctgaggtactggggttggaacttcagcctatttttgcagggacacaattcaacccatagcaccagctctgaaccagggtagtgcatggaggtggagacctagtaccgtgctaaggaccccagccgacagtgtggtccgaggcaagtttcccttctgcccaataggggattggattgactgatttctactgtaatatagtacaagtatatatagtagaagtatatatatagaagtaacatagaattctatttttatagaatggctgtaatttatttaataggttttctcactgaagtaatttcataaaagtttttggaaagttggcttcatccttctactttcatgcatttgccgcagagattaagtgtctgccaggtattctttcagcgtgatccaccggggaacccacagacccagcctcctcccactttccttttccttctgagatctctttattcttcctgttctgtgtccaaaaagaggaaccaactgccccctaagtctatcctcacatatagagcctcttacatgacaggtgtcaggagaaactaaaaacgattagacttagaaggagctaactattaaatggtgaatgctcaatcaatattcattaatcaggaaggttgaccattgactttaccctctgtgacttcactggctctttcacagcaacgattcttgagaaaatacatggccaagccttacattagctgatctagttttcagagccccgctaggatatgagtcctggtattgcagatgaggaaacagggtctcacagatacacagaagctcctctgggtgcacacagtgagtactgggataggcaaaggctgaactcaggcagcttctctccaggatccaccctgagtgatgagctgtgtcccaggctggagaagagccatgctgcccactgtctgggcctatctacaagctctttcattcattcttggatttttccagctgaaaaaaagtgttatatgaaggatcagagatggcatcttaaacttttttttgcacaattcatcattaattcactgttttttaaactgttgtcacaaagagttgttttgaatgccttgatgaactatgttttgtttgttttattatattttcacttgagatttttactgtgaagcatgctattttgaagacaaaatttttaaaaatagagaagggcaagaagaatggtggacaatgcaggaggtgacaattggtataattacagtaaacatttataggtcagtggaacataagccctgagggaaggctctgaaagcggacctgcaagcaggagggagggagggaaggagggaggcagccctcgcaggctgccgggaagcaccagggatgtcgtgcctcactgtgccagcctcacagatggcatctcagcgacatggctgttcttttgtcttttcttcatgagcatcttagagaagcgcatttatgcacatttctacctacaaagttttgcctcagtgtgactcatcttctttctgtctcagataggattactcttcaaaggaaagataaaaaaacaagttctgaatataaagatgaagccaactgcagggcttgttgaattacctcagagatagctagagttgtctgtgtgtgtgtgtgtgtgtgtgtgtgtgtgtgtgtgtgtgtgtgcgcctctgtgtgtgtgtctgtgtatctgtccatgtctgtgtgtatgtctgtgtccatgtctgtatgtgcatctgtgtgtgtgcatgtgcctgtgcatgtgtgtctgtgcatgtgtgtgtatacacatgagtgcaatgtcccatattggcaaataccacatggtaacgtcctgcacgccacaggagctgtatatatgagctgtattttcatgatggcccactgggatagggattaaatcagatgatcaccatttatacctaagtagtaacacttaaaaatgcaattgctctctgtcaccacggcttaatctatgagcccctaaggggaaaaaattcttacattaaaaaagccatttcatatatagataaatgttgaataggcaggtgttgatcagaaggtctaatccccatccacgtgaaatgaacaagtcaagcagataattgttttactagagctttcctttgcattaaatgtgcctggaaaacatttctaaaaccattcttttctttttggttgaaccattatgaatgaatcttcatcctttaaaaggctagatgttcatgttcaactgttttggcaactgacctaaaccaatattattatgaacacattttggttgttttggttggacattggtaactgccagtgaagttggaggtgagaggagttaactacttccttataatgtcaccacctaattagaataaaagcatcttagattaaattctgatttacataaggacatttattaactaaacaattattcagcaggcatgaaataaacaaatcatatgactagttctctctctaggtgcttggccaccgtttgcaagcttcccttaaggcacaaaatccaaaattccagagtcaatatttcatcatcactatagacaaaagtttgtggtattcacagctggacgctggacatctcccaggacgtggttcctgagtcattctgcctctgagtgtgttgctcccatggaaatcatgcacctccacggaactcactcaggctcctcggggactcctgagtctgcagtcagattgctagtcttgctctgatttcctacctatcggacattccatttgactgtcttgccactgaactcaatgggtgtaagctgactcttcttccctgcatatcagcatcctcctgacttccccacttctgtgaatgtcatgatcattctttctgccacctaagcttgaagcctacagtcattttttaacacagccaccttcagctccaattccaattccaatcagtcactcttttctcaaatctcccttcataccagttcctgtccttctgtctcttctaccctaagccagagccatatctctgcagatcaagggcctttttgttctgtttcttccccagtcaattagtttacatgatgccaaacccatcttcttaaaaccacctggattagatcactcctctgtttgaagatttccaaagaggccttattttgtagtggaaaatgtccaaactcctttgcatattcacttattctcagcatgcttttaccaccttgcgttcttctccttcacggcacaaacctctatgccagctggattttccatccataatcccccaaatacatcacatgcattgttgcattggccacccttgttagtgctttttccatgtggtgttcttactttcctccttcactccatgcccacttcctcaaaacacacacacacacacacacacacacacacacacacagcttcttggagcctcaaagttggttgctagtattttaagtgcccggaatttgaaatgaaaaaaaataaaagtaaactggttttaaatgtaggcgttgccacgtattggttctactgtggcctcagacttgttatgaaatatttccaagccttagcttccacatgagtacaatgggaataatgcctaccatcctattgcccatccttaattaatcttagttccgtttctgtgccacgtttcctccccagggaagccctttatacccttactactcatggatttatctcttctctgagcccatagaactgagttctgttgtcactgctttagtaaagtcaccatttgcttgtttaaggtccctcttctattttcacttattgtgtttcggagccacacattgtatcctatactagactttgaaaatactttagttgcagtgcattatttttgtgtagtcagagtacccagggcagtttctcacacattctctcgttttgtctcataacatcccaggagctggatataatctgtgatttatgaggagagaaagtgagagacagaggtgtaagtgagttgcctaaggtcactcagagagtgagtggcagaagcagcacttgaatcaagtcttaggattctaagcccggggctgtctgctccctcctagacctgtaactttagaagcaggaatttatttcatattgcttatatttcagtatttatttttaacccttacagggcccggtcttgtgactgactgtaattgagaaggtactctacaaatatttttgaaagaataaataaaatgaatactacagaccatgttaataatgtcaaataactctgggagtttgagggataattctgtcaatacgagttgagggtgtgcttggcctctccatcatttaccctgcttttatgagggttagcagcacaatgtcttcattctaaaacacagaatcatgaggttaaagaaagcatgcaatgccatcagctgagaagaaccagaattcacagtgcaggttctctaaagtggttttgtgttgctctcagcgccgtgaactcccaccattatattcatagctttttagcctttggctaagatcaagtagagtgtttgttctcctggcttttaataagtaatgtgttctccatccaaggacaacatatttaggctgtacatgcattacgaagtattaagctcctgtaacagtaaatttctcaacaggagatttatgtgaattctcttggatgttattctgttgacattaggaacaattaggaatataaaatgccatggcagatttttctgtgatgctggacgtactgtcaggactctgagtctgtgtactcggaagtcttcctcagacagggacaaggcgcattctctttcttaggaagagaattaacagtgcactcccacctccctgtgctcaccacatgggcacacatcccagggcgagggtggagtgagctcagaagaacccacgctgagcacaatgaaagcaaaattattatcagagaaagaaacagattgcagcaacctgggtttaacaggacacatagtagtagacaggaagtttttcgtgatctataacacattttcatattagggtcatgttaatttcacaatgaattgcatattaggctcaattagagaaacaataaagaaggaagacgggatgacagaaagcattgaagaggaggaagcagaatggaggcagagggtggaatcaaaaataaggacaaagagaggaaggggaaagagaaagaaaatgagaagtaacgtcagcagctccgtaggttctgaggtgagttagctggtcgtaggtcaacagctttagtcacacatcctgttattcactttgggcatcagagcacattttcactaccctttgaaatttccatacagtctacagcgattttgtagcaatctttctttaccgggaaattgcttatctgcttttcttttcaatctttgaggtcaacttattaaaggctttagtttcacatgaagcccgaaatattttgaaggtaagaaaaaaatgtgcctttggtcttaaatatttccacttaaatcttgattctgggctactttaataattccaaaataagagtgagtggcttcttttttcaataactgaaatacaacatttaaaaacactcatgtaattattttgctgtgttcagttgtttgaaagtagacaaggtttgatttgacagagctgtgttttaacctgggctctacatgtcactaaactactgtcccctgtaagctcctgtttcctcgtctacagatagaggtactccagtagctctccaggctctgtgtgtctctgtcacaggtttggcataaagtagacaggaatggtgtcagttcctccctccccaaactctctccaatgacactcccaccaagtgcagaaacgtacagaaagaactcttcctgcttttcaacttccattgatcacactgaaagaaatatcacattagcttataaggctcaaaattatcttcagtgctatagctctgtgtactctaaaatcagagcaacataactttggttctggatgaaatcgaatcaggacctgactctactcctagaagaacgctgaccccaaactcctgttttgcagaaccctgaaggagcaagtaaagatgccagccattaaatatgaagaccttcagagacctagaactaatggaactaaatcaaggatttctattttatcttagattaaaatgccatttatatgcattcagggcatagttttcactcccatgaggaatagattcatacctgtataaagctgggaatataatgactaattaaatatactgtatgacttcaatatagccaagaaaattacaatcattccaagtaatactgtttttccccagacacaaatctgaggatcttgaatcttagcactggaaggaatgtagacatcacgcaggctcatcacttctctggcacagaacttgacttgccttgagcacatgtctggtagcttcttcctgggaacatagatgacataacgcatattgcctttccaggcagcttgatctgtcatgagacagctctggccttttagaaaccagcctttatactgagctgtgagcctgcttctctgtattgcacattttttgttcttaattctgaacaaaaagtttttgtgaattttcttcctggaaatggtcttcaccacttgaaacaactgtcatgcccatctgagcatatttcttaggtgaggcttcccagtttgggagacgcttctctcataaaatatttctgaattcatcagtatctctgttcctataaaacgcgtggctgtctacttcaggcaaatcctaaccaagctcaggtaacagtgaagtgattgtttgctgtgaaacagtattgtactgttgaagttaaagaggtctatgattacattgtgtttattttggattttgcattattgagtattttttactttattttctttttgtaaagcccatatcactacctataacaagcttttgataagtgaactttctaatttttcctattctatagctatgtaagggaatctttaaattttgccaggactttctagcctaatgcaacaagggaggttacattaactataataatttaaatttcattagttttttcccacatttgctgaagcaattcttctacacaatctatttcattatttctgggagttctaaatgtgtcccacaggaacacatcccccttcttggaaccactgctcttccaccagaaccagcagctctctggactccccaaggcttattaggtctcattgttacccagggagtcaagcagctatcacaaggccatgctttggctttgtagctgctccaatggatgttaaaatttctcactttgttcctgatactgtacggaattatatgcaacatctctttacttaaaagctctctgcttctcccaggatccagagattcatccctggaaaagcattcaagtgcagctgccatattccatttagaatgcctccttccttcagacagccaaggttttgttattgggctcagctctatgtgcccagctccttcttcagtacaaggagctctctccaaagaggtcactaaatcccctgcaaatagtctttaactagaccttttcaaaccttgtctcttttttttctttgaaatgacactgtaccatgaacatttttatgaaatcattaaacatgttaaacttcatcaaagccatcattttaaagtcttccatgatgtctatcttatagagatacaccatactagaatgcatttttttcatttttctattgctgagaatgttgggttttatacatagcttgttattttaagtaaatgttgtgctttaccttgttcctattatacttttaattcagcctactgttagcatctgtggatgattttctatgcttatatgtcactcaatatattagcatcattcccagcttttggctttacatatgcatttttaagatgtgtctcttaccttttaaccatcaaatcagattttagttgcttgatagacccagcttttatatttcagtttatgccacctctaaggtcgttgtagtgagatgcctatataaaagacatacaaattcaaggagtgaattaaaatctcacttgaaattttaaatgtcactgaatattaattgtggtcgctaattggtatattttctagtaatcacttcaaaagctcctcattaaaaataaatcataaaaatatagaattataagagcttttaggtatagttcaatgatctaattccatccatttatctgtccatctatccttcagcaagtcatttatcaccttccttctgtatattacagatgataataaagacatctgggacaaaaaggtaagtcacagacctacccatgtgtatgggtgatagagtagtgaatacaagtgacaaagggtgtgattccttctgtttgagaggtgaagaaagtattcccaaagcaagtgacattgaatcagcaccttaagataaaacgaagaactcagcagaaagaaagtgaatgggaagatgtggtaataggtttaaatggacatggcatgtcggcaactaaatttctgtagctccagaatattctccccagtcccctgagacgaagttacagagctgtgaatccggtagtgaaagccttggtataaggcgcataagaaatgtgcagattatctaccatgaaatagaggaagaaatcaaggttattcaagtagaggaatgacacgttttagaaagacttttgttataacgttatgggaaatggattataggctggaggcaagagataagacattgtcagtgtgacagaatattttattaataaagcacataatttatactcagatctatgtgagatgagaccaattcatgtcaacatgtccaatgtttttgaaaaaatgctaagtttttattatcgcttttgtttatttccctgtgaaatatagtaggctagccctctatttctcctggcgaaatctttagataggtggaaaaaaaaatgttgaaaaagggcatcaatgacctcttttatcttggttttatctgccttttggaagatacttgattcaaagctatgaaaaagcatctcaccaatcccgtatttcacttggttggacgatgtgtcaagagaacgcctgaggcttcctctgtccgttaacaggccagtcatgagtcacagtctgaacatgaggaaatgttcatgtactttttcatagtcatggcaatgagacttttttgtgcccaaagtactatcctcgcctaaagtccctgttaaaaaggttattttctgccacaggcaggtagcagaatgtcaagatccaattccaagtgcttcatcatcactcggatagcctcaggaagctgaggttttacagctgcctggaacccacatgcttcatgtgatgtagagcagccctgttaattagctgtttcaggattcttaatgccctatggctttggaaacacttgttagcccacagagggaggggaagagctggaagcaattggactacagcctgaatttattttaattcaattcagtaaccaccttatctttctaaatccctgtttagaatctgttgaaaattatagttgatttaagtttttctcagtgatgcatcctgagagaagagggagattacaattcaaggttttctgaagccacagaaatgtggagtgctgcagaaagagctgatcgatggaactttccagacacatgtatgcaattttctaaaggctagaaaatagatgccggggatggggagaggggaggccagttgatgtggaaaggcttgtgtagagtgcccacgagtctgcatttctgttcacctaccagaagaaacactgccagttccccccaccctcaccccccaaccattctcactgcagagagctggcactcaacaaactcataatttttctcaatacaattctcatgacataacctgaccaaccatatgaaacctaatgaagaaaacaaccattgccattggcaacaaatgcaggagttgcatcacaagtaaaccacatactttacttcacaaatttgaacattagagtaccaccggcaaaaacatggtaccatccttcggtatggatgagatatcagtttacaaaaccttcactggaaagtccataccaaaatttttaaaatgcatgcaaaagctaattgtgttgacatctttcttatcagagctattgcaaattattttgtctagaggtggttcttaaaacagccacctgtctgtccactaatcatgtacatagcatcctcttcctcatattcatcctctgaaataccaagaggtgaaagagtgtttcagtagctcaccattcttggctgttacataatgggtcagattcctttctgagtagtaggagaggtcagtgatccagatctatatatctttgtgctttttccactaatacattcttagaacctagtaggtgctcaataaacgttagctgtatgaatgagttagtgaatcaatgaatgaagtgttaatttttagaaatattatggtcagaattttactaggaaaaacatttcttataatcacaaatgaaagctaggtttactcaaaattgggaatagtaagtagtctttccatttcccataccacaggtatgcttgtattcttcttatatgcttatgaaagaagagaatgtggattaagttataaactatttgtacatgatattgtatatgtaaaaatcatgtcagttttgaggccaggatttctttgtattgagtaaaattttcctaaatatttgcccattgtattagttcattctcacattgctgataaagacatactcaagactgggtaatttataaagaaaaacaggtttaagggacttacagttccacgtgactggggaggcctcacaatcatggtggaaggcaaaaggcatgtcttacatggtggcagacatgagagaaaatgagagaaaaaccatgaaaaaggggtttccccttataaagccatcagatcttgtgagacttattcactaccatgagaacagtatggggaaaattgcccccatgattcaattatctcccaccaggtccctcccacaacacatgggaatcatgagagctacagttcaagatgagatttgggtggggacacagccaaaccacatcacccattttaaaacaggcttgatatcaatttattgctagaaaactataatttgtattttcttttacatttttaatgactgattgtacatttgttccctcaaaagaggctctccaaaatactgcctaattcctatgttaatagcaacccaaacatgttttcaatactaatattaaaacaaattagcttaacaaatacaaaaggtaatgcctggtttatacaatacggatttgagaaatgcaggtttcaacctgttccacaccatgcccttcattatattcttctgccagagattttattctttacttttcattcaatcagaaagaattgagaggaatttgaacccattctgcctatttagaatatcatttgtactgactttaatcttttgctcctaatccatgaattcctgaggtcttttatttacatccataaatttgaaaagcacaatcccctttttttttttaaaaaaaaaaaaaggaagttacttttgggaatcagagacatgtacctctttgttctcttggagagctgtgggttatgggagggaactcctcatcctgtttcctgatatgcagtgacttctctcttacacagatgagtcctaaaacctttgtgagctcagacaagttggctggttttatttttatttttttatttttgagattgtctcactctgtcactcaggatggagtgcagtggcccaattaccaactcactgcagccttgaccttccaggctgaaaccatcttcccacctcagcctcccaaatagctaagaccacaggtgcacaccaccatacccactaattttttgtagagatagggtttcgccatattgcccaggctggtcttgaactcctggtctcaaccaattcacctgccttggcctcccaaagtgctggggttacaggtgtgagccaccatgcctggccaagttgcctggttctttacatggaatgttctttacatggaatgttccaggatcaattaaacacagataaataacaacttatgttttgtaaataaacacatctgaatggaatcttactccaatttagatagaaattgatatttttcctttcaaatgaaataaatgttttagactaggacatcccaagtgaattgaagattggtacaggagcctgaggaaggaagtttaagagagtgaaagcatgagagaagagccaagattatgtagcccagagaaggaaagaattattacctaccattactttaagggactgtgcttcctcacagtagtggaagacagatgctcattttttattcaagactgtgtaaaataaatggccttaatttatagatgtggatgctggtttatatcaatacacctcaacctgggatggctccaaatcttgactacacatgggaataacttgaggagttttacaaaaaaactgatgcctgggtcacaccctgagagattcttatttatctggtctggggtggtgtggcccaggcactgaaatttataaaattctccgggtgattctaatatgcagccaaggttaagaatgcagctgtacagctgtagatggaagaataccaaaaccaggccttctgctagtgcctgagcttctcctcattttagtttctgtgatgtgttcagacattgtttctagaatctcctgggtaatatgagttatagtcctttggatggagtaatacattaacacatccatactcacatagtttggaaggggccaggatgcaaagggaagttggaggaggaagagaaggaaatggtaaagtccaaagcatgggtgaaggggggccaatataaacccacagagcaaaaaggagatgttgggtcatcatattctattacataaattggatttacatttccttgtctttcattgctggtctttattcccacaagtctccaaatacagtcataaaattctcatgagttgttatagcaaaattgcttatcatttactatttcttaaatgaatgcataaactgtattactttggcagaaaggatgctgctgggtatcatatgtaatgtatactagtaaggtggacaggaccattaggactttaaattcctttataatctcaaaagtctgtgattctgatcttcctggtcttgcaactccagaaaaggtggtaatcactggagtaggctatttatgggcctgtgagatagtgaaacatgctattaagacaaaatgagagacttccttctctgaaatggttccatataaaagtaatatatggcttaagtatccaggggctcatgtaatctctccatgtcagtatcttttacggggaattatttaaccaaacatgtattgaacacttacgtgctacactaaaatcccagatttgtcaagttcccgtttaaaaagtgggtactaagcctaagatattagcaatacttgtatctgaaaaggcctcacatctagaaactataaagaacttctaaaaatcaatcaaaacaacatagttcttagaaaatcacaaaggaacaggtttttcagactcgaggatgtctatatggtgaaaaagcagcagtattttagagttggtctgaactgactcacaggaacctatttttaaatgtccagaaatttgctaagcaaattgttaatgcatcaattatctaaagtttaattatgtaaacttcaagttatctgaaaaacataacacatactcaaaactctcatcccttcctaagtgttttactacattctgttatttctgtttgtgaggtcatttgtttattgcatctgtatgatggaaacactgtataaaatgacatgttattcccaactccacataggctgatataacgttggtagcttaaaatcagctttagtccaggtatttatacaatggaaatggaaatcagcatacgccacaaatcaggagttgatttttttttttttttttttttttttttttttgagatggagtgtcgctctgtcgcccaggctggagtgcagtggtgcgatctcggctcactgcaacctccgcctcctggattcaagcgattctctgcctcggcctcctgagtagctgggattacagttgcccgccaccatgcctggctaatatttgcatttttagtagagatgaggtttcatcatcttggccaggctggttttgaattcctgacctcgtaatccacctgccttggcctcccaaagtgctgggattacaagcatgagccactgcgctcggcccaggaattgattttttgtttaatggtgttgactgtctacaaactgattaagaaaatgttattaaagttgtacatcatgtctgcaaccattaaattgtaagtagcacaaaaaatctgggggaaacagtcttctagactttccagatgcagcaaagaaattgccttgttccaacatacatttttattgtttcacttttgtcttacttaaccactaagtaagacatagttcctacataaaccaatcatgtaggaattacactcctttttcaattacaactttggtttgattacctttgtggtcttctgttctatcaccgtctttttttttttttttttttttgagaaggagtttaactcttgtcacccaggctggagtgcagtggtgtgacctccgctcaccataacctctgcctcccaggttcaagcgattctcctgcctcagcatcctgagtagctgggattacaggcacctgccagcacatgtggctaattttgcatttttagtagagacagggtttcaccacgttagtcaggctggtctcgaactcctgacctcaggtgatccaccctcctcagcctcccaaagtgctgggattacaggcatgagccactgcgctcagctcaccatcgcttttagataaggaaactgagccctagagagtggttggctcgcctcaggctccaggacaaatatgacttaatcaaaactatactcctgttctttcattcacataaaactacttatctaaggatgctgcagcaacactgctgtcaggccagaattcagtaagtttacagctgaggccttatctatagaccattgattttgctcaaggaaaaagttacacaaactagcaatagagtcctgaccaggcattacaaattctacactgatgtgtaaaagagggactaggcacaaagaatacatgcttagcacaatctatctttattataggaaaagcaatttaaaacatattttactgagtagtgccagaaaattaccgaaaaagaaagttaatgctttttccttctcaaaacccttctataatgtgtaggcattgtcatattagagagactcctgggaaatgcttggtcaactaaaattgttaaagagctaaaattgaacattgactcagaagcaatgtgaaatacatcttcccatttccaggatggagtgcagtggtgagatctcagctcactgcaacttctgcctcctgggttcaagcaattctcctgcctcagcctcctgagtagctaggattacaggtgcctgccaccatgcccagctaattttttaatatttttagtagagacggggtttcgccatgttggccaggctggtcttgaactcctgacctcaggtaatcgacctgccttggcctcccaaagtgctgggattacaggcgtgagccaccgcgcccggctcactgacgctcttcttaatttcttctgcctaagaaatagaaggtattctcgagggaaaaaaggcattgacaactagtacagggaaattgatgacaacataaggctgtttgaggaaaaaacgtgggatctcaaagactgttggtgggagtgtaaattgaataatctactttggagaacaatttggcagtttctattaaaatttaaaaatgctgatatcttatcagttaatcctacttctaagtatctattattaaaaaaaatacttggcatgtattcccaatgcgttttgcaagaatgttctttgtaattgtcaaaaggtggaaatctgaatgccctccagtagggaaatggctaaatgaaatatgaaataaccatactattgaatactatgcatcagctaaaaatagcaagagatctttgttgagtgaaaaaataaattgctgattgatcattaaatataacactatgtttttaagaagcctcagaaaacagtaatatatgatcctataggcataaaattatttatgatatcacacggaggtctatagaatttattgtcctctatggtagccactagccacatgatgctatttaagtttaaattaataaaattaaataaaaataaaaatttcatgtctcatttctacgagcctcatttcacgtcctaatagcaacatttgaatggtggccagtgtaatggagagtgcagatctagaagaacaaacacaactggtaacagagttacctgggggaaggttgagtttggggatggagggctacagaaactttagagttctgcagaacttttaacatttttacaatgagaatacatcatatattatctagctaatttaaaacaaatacattgttaaaatgaaaagcatgcctagccaaaggatttctttcttttttttttttccgagacagagtcttgctctgttgcccaggctggagtgcagcggtgcaatctcggctcactgcaacctccgcctcctaggtccaagagattctcatgcctcagcctcccaaatagctgggattacagcatgtgccaccatgcccagctaatttttgtattttaatagaaacggttttcattgtgttggccagtttggtctcaaattcctgacctcaggtgattggcccaacttggcctcccaaagtgctgggattacaagtgtgagccactgcactggcctagcaaaaggatttctaaaacaatgtagaattttagtagatagatcagtataaattgatttgaacaccctacctttttagcctgttaactatctaaaagcataaaaaatagtaaaacaaacggcaaaatcatttcctccttccttttctacctgtgtctagtgtctattgaacacttactatattcccagcatttaaagtacaagaatcatgaggcaactgctgtttagactgaagtgttttcaccaggggtgtatcaagaggatttctttgtcataggttgatttcccttataactgattgattaaataattactagttggcttatgcaatgtttatataattacaggatataaatggtggttattagcctaactagaatatatgcctttataatattggtgtaatattcatatgtattttactacagcttaaaataataatttcagaaagaaattcaaattgattttcataatttagcaaccatttgagctcttccaggtcagaataacttcttgggaagccccagaaagaaaagcatatacctgcttttacagttatccatagattgactataaggctaggtattgagttggcggatgcatactttcttaattctttagataataggtcaatagtgtggtagtgaatcttgatggtaagtgtccttcgcatgtttcatactgcacagtagactagactgaaagtcccaggagactgtgagtgtagcaaagaatgaatcttgtatccccagatacacaaagaccatgtcttcactggacccacagaacctagcacatggtgtgtcttattaaatgcttgtagaataattaaataaattacattcagaaaacagtctataagtcttaaagtttacctttcaattatgtaattattacttttaatttataatttattaacagacatagatattcacaacacctgcaaaagagtttatttcaacttcttttttttgtctcatctaaaaagtgtggatttaatatagcaaagtttgcttctagaatggaatcttttagagtgtatatgcgcttttgaaaaaaatggtttatgattttgttatgtaatactgttatataagttattttagaaattgcatgatttattataatatcagcagtgaatttaaacattacacaaatgcctgaatataaagaaataggatcacctgtgtccaagttaattgccttcttttgctgtattcattagccatcaatacctacataatctaaggccaagatacatatggagcaatctatggacaggcaatagcatcccatgggagctttggaaattcaggagctcgagcctcaccccagatgtactgaatcagaatctttatgttagcatggtctccaggtgatttgtaggtccatcaatgtttgaagagcacctgtctggccttcagttgcctttatacatcttcttaccaacagtaccatctagtccaatatttttctgtcctgttagtttgtccatagtctcccaacaggcttctgtccacaaagctgttatttagaggcatggccccatccctctcatagtctttgctaaggttatgtcttttacatttggagatacaccaattgcagaggagggtgaaattagcctgagagcaggaccataacaataacctgattctaatggaggctgttaccagggcagccagtacccgaactaagtcatcattctgctggaagcattccgtttggctgcagttcaacaaaaagaaaaaagaacgcactccagaaaatcaggaaggtttgcattatctatcagctatgttcaaggagatgtttgtggaaagtcgagttaagggttcctggaaacattaatctctggacatgctggaggatgcaggtggatttagagccaggcgagtctacattcacaaatcacattaacatattaaaagacggagagctcttactctgaggagccccatttagttgtattcaacccagctccatatattttttaaatcacaaaatgcttttttttttttcgtgaaacattcattaaaattaggcaaaactcatcttcggtgagacatgctttgtgaaatgtgagtggagaggttcctctgaaattgtctaaaaggtaacttaagccctgatgttttagaaaatttgacttattatgtaacagtgaatatacctatctgtgtagtttcactattttagaagtaaaacaatgctttgatttcaaatattaaattaacttaggcattgctctcccactccatctcccaagctgtgactcagatatcagaacaaattttttacctagttagggaaaaaagtttcccaagtttcagagccataaaagcatcagtaaagcacctatttattgtagcactctcttgttttccatcttcaatttcctaaacattgaatatcttgtttttcatttttcttctaaaagcatttgtggtatataataacaccgcatgaaagtggaagagactatattggctcaggatgcacttgatatttgttttccttaaatgacaaatgaaactcccaattcaacactaggataagattttttttaagttattaaaccttagttaagttatatgacttcatactgggaaagtgagttccagagaagtttaatgaacttgttgaaggtgactttgctaacttattacaaaatggggaatacaactctggtttccctaatgccttttgtaaagcatcccagataaaaatctaggtttcagaagattccttatagttaggtatgaaaaaatgttatttctgaaaatatgatttccttatgagaaaccattgtttagatatgtttaactttagaaaaaatttccaactataattaaaatctatgaattatagacatgttcagtgaaatacactgtctcatagaaaccatattcaaaaaacagaatgactggaacagatgttatgtatggggattagagggaagttatccagttatattatactaatttgagaaagattccaaaaaaatcctttcttgggggccggtcaggggtgggtatagcaaatgaaagagaaagataaggaaatgtgttccttggtgttgagttttgaatagatcactattgtgttatattcctctgaatttaggatacctgttggattttgttccttatcatgtctgttatgtggacaaagacaacaaacgtttgtttcttcttgtcaatttcattatgcacaaggattctgaaggtccacccaagatctttcgtgcactaaatgtctggtgtttgtaatacaatgaacaattttggggagtttgaaaatcttttgattatgaccttgaggattagagatcatttggtgtggatgacttcgaggaagttatttaattttttttttgtatgtcagttttctcagatttaaaatgtgggtaatagtaaccaccttgttagaatgattgtaatgatcaaaacatgtaataatgcaaagtgcttatgcttagtgcactagtgttttgcacttacatctagttatttttttctcagtaattcaataggctaagggatgatctagtacagattgagatatgggatttttgttgttgttgttgttgacaagttgcagacaaaatgtttggttattcctctcactgaaataaaacccagaaatatagggtattataatatgttaaacatttagtggctatcaaaacttattttcttctttgaagtcagagtaatatttagagagggcattctggggtttccttttagcaaaataattagaagtaatttcccttagaatttttagaatgactatattaggaggaaagggaaggttcttacctaaattgtattgcaacttttctctgaaataaaataaacatgctgtgttaaaattgctggtataggccaggcacagtggctcatacctgtaatcccagcactttggtaggccgaggtgggaggatcacttgaggtcaggagtttgagacaagtctgaccaatgtggtgaaaccctgtctctactaaaaacacgaaaattagcccggcatggtggttggtgcctgtaatcccagctactcactactcaggaggctgaggcaggagaatcacttgaacccagaaggtggaggttgcagtgagctgagatggcaccactgcactccagcctggacaacaaagccggactgtgtctcagaaaaaaaaaaaaaagaaaaaagaaaaaaaaaatgccattgtaagttgtgccctataaaatgttaacgtttctttcaagtgaaataatgacttactatttcagcagagatcactctaacatttagttttaatctaggaaaaaaaccccatataactagatttggtctttttattaaaatgaattgatcttagaagagcacatcatatgctcaaaatatagctgtcatgtaaatcaagacatatatttgttttgttcaatgaaatctagaaactcttaaaaaaactgtttactggcttttgatgtttaattgggtggaatgtataagaaatatctgatgaatttttgacttctctattgacttccaagcttatatacagccaatgaacaaacttttctaagtcttgtactctctttccatttctacacaaattcatattgaataggaaatattgaaataagatctttagaatcctcctcttgcaaattatagaacatattaaaaccaggttaaacttatttaaatctctttatatattgtttacccacctaccacgtaaatgttactgatttttccatagtaaaaagtctaaaaatccaatgcatcttacctcccctaaactacctatctctccaaacctctcattattcctccatatgtaccttctttcaagacttaattcaagccctgccttgtttttgagttattctctgtctagataaattattggtcactccttttaacccagaaggcaccaatcatttctattattaatttgattcttagtatttattttctttgttgggagttttatttatattcccttctaaagtagatattttacttttttggaaatctctgcctactagcccagtacctaataaaaggtcaatgatgatgatgatttgaaaaaccatgttctacagtgttcagatgtgcttttagataaggggatgatataactttatcatcaaactttataatgaaaaataatcatgatgaaaatttaagataaaataattttagaatatattatttggctaagtggaaaactatcatggagtttaattaaaatttcttcatattgaaagaagacaggtatatagaggagaaaaaaacataaaaacaaaaaacatctcaggaattccaccttcagctgcccttacttcaataccatgcctcagaaagaacttcatgacttggcaggtttacaggttgactcagtgtatatgctgagaatagccaagggcaaaatttagtgttaactagatcaagaactcaggggacccaggtgtctactgttttccatagaaataaccataaacaattttaaatactagatctgctttccttttgggtttgtataatgtagagtcaaaatagaggctctggcacctcatagacacagatttaaatcccatttatgccattggtaaactatatgacctctggcaagttatttaacctccttatgccctcatctctaaaattgtagtacgaaagcaacaccctaagtatgattgcaaggattaagggaaataaaatgcaaagttcctggtacataattgatatctactaagtgtgaatttctctaagttcctcatatcacataatggtagatttttatttactgggtggttattctgtaccaggcactctcctaaacacttatatcatggggattaacacatttaatccttgtagcattcttttgcaatagctactatcatcatcatcctcattattatcgtcctatttcacagatctggaactgagccactgaaaagtaaagtaacacaactagtaactagtacttctggggttcaaaataaacttttcatttctaaaattaacccataccttcttatccagtagacaacataacctctcccactatcaggtcatttccatggcctatatcctgtggacaatttgaaagcgatttccttttaacccttgtttatctaattagaacatagtttggagaaacatacaatgttttccatagctgagtataaatcatttcttccatccttttgaattagccacatcattgctctctttccattgtgggaaatctagccttgcttgtttgtacctagacaaaagcacactttttgtgtcagaacctgtgaaaatctcatcttccttgttaccacctataaatgattaatgagacaaaacattttcaaggattccaaataatctaaaaaatcccacaaattttgaaaatccacaaagaggtatctaggaaaactttcatgaagttaagagatgttatctgctgttctaggcgtgggtgactttatcaaaacatttcgcccactttcaaatttccacttgttaaaacctgaggccttatttggctgtcacttactgtacagtgtttttcagacaagttcctggcagctaattttaaagagattttgtgaaaaacacaagctgtggagtgctcctgttggaagagcaccctctgaccctctgccttaacataagaaaaaattgccagtctgtccaaacctcacccacctttggttatcttcagaatcttacaatttgtgtttcctaaggcagcaattttcaagcatgactttgaaacactgcaggctttttcaagttatttcaaggactggccaagaattctcaaaacaaaattaattttgtatttttaaaaagcagtatgcatatcatgtatcatttggcagatttaggaggttaacagtaagcattaggaaattgaatcaataataataatgggatatggggacctgtaaagaaactctcaatcctgcttcattacttttaatggcaaaaactgtaattacttttgcaccaaccaaatacactgaaatcctttaacatacaccaaagcaatgggagatctgcagaatgcttttgtccatgtttaaccataatgatcaatgcattttgaatagaatattgttatatctactatttagcttaattgtgatcattaacaaagtgcccagactctctgaacattctacatggcatactatttgtgagaagatcagcatgtaaatagtttactctttgtaagctcttctacaaggtggctaaaagcaagaactagaacccagagtcccttgcattcaatgaatttccctattattgcccatatcattctttcttttctttctttctttctttctttctttctttctttctttctttctttctttcttctctctctctctctctttctttctttctttctttctttctttctttctttctttctttctttctttttctttttctttctttccttctttttgagatggagtctcgctctgtcgcccatatcatttttagtataatctcttcctttacttggtcactaagaatcacttttctctacttagagccagacatttaaatatctccagcctccaagatctcgtctgggtacttgggctgcactttttcatgtcaatcattttgcacttgtcatctatcctattaggctataagctccccaagggcagatatagagacatagtatcaagctaacctttttatttatttatttatttatttatttatttattttgaggctgggtctcgctctgtcatgcagtctggagtgcagtggcatgatcatggctcaatgctgcctcaacctcccaggctcaagcaatcctcccatctcagcctcctgagtagcctgggactgcagacgcatgccaccacactcagctattttttaatgttttatagagacggggtcttgctatgttacccaggctagtcttgaattcctgagctcaagtgatcttcctgcattggcctcccaaagtgatgagattacaggtgtgagccaccacacctggccaagctaatctttaaatatcctagagcacccattatagtgtctggcaaaaaataaatgcccataaatgtttgttgaatggaactgagtcttcagaaactagagattttttctaaaatatttttttttgccatttcagtttaatacatattagtttttctcacttatcctatcatctgaattttttatttctttgaacctgaacaggctttgtgtctacagactgctgagcctttaattttgttgtcgtttgttttgttttgttttgcacaaaactaaaaacatgtacaaatacatttttaattgcatttgttcattctagtttttactcgtaaagtgcacttctttcttttctttctttccattaatttctgaaccttcccttcttaaactttacccagagttttctcatcatatacgcatttcattttcattgtacttttctgcatctgactatttcattttccagttgttctggtatgtttttctaagtattgtccaatcctttccattaagttacaagctccttgagggcaagcattgcacacctgttttgcacaacttctaaggccgttcagtccctcagcccactgtatagaaatatagtatatatatagacaatacacacacacatgcacacacataccttgccacttaatgatgtaaagtgacaaaaacttttatattggtaaaaattatgagaataagaataatcatatcctgattcttcaaattcaaatatttgtctaacattttttgatgaagtcatagcacttatgtgtcattgaattgttgtgggcatgctaacaggaaagatggaccaagtggttgaccctgtccttctgtgaatagaacctcagagtacacttttctgtaaacatttaaaagacaaggaattggaacttaaaatggagcaaccaggggggcagggaaacagaataaacttttaaaattgacctaatagtaatcataggaaacaaaaagaatcattccagtctccatttttttttttctggatgcattttgtagctccctaagttattgggtttttaagaaacataaaatattcctagatcgttagagatgtgatttgatttcaatcccacatggtctgtagcatcactaagctactgggaacttccctatgcaaaggtttgagtttctttccaatgctgtttaatgtctgcacttctagtgtccacataaatgagatttaacaggctttacttcatactttcttgttacaacatttttactttttttccaattgcaaaattatttcttttaagctctctgaataagtttgttgaagctctattcatcacacataaaaatcttacattaaaaggcaataaaggaaatcacgaaaagctagatgtattccaccctcttatagttgaatacataaaattgtatatatcacaaatagtaattgaaactactcttatgaaaactatctgtccttctggaggggcattagtttaaatgcaaagagaaaacatatcatttgtgagtctaaatagtgttgttagttctttgaaagggccctaattaataaggttgtagaacacaactgcaacctgtaaagcgttccatgtgtagtattttgaaaccttttgtttgtttgggttctaactagagacagagggagaaaaagtcaatttcattctcatgggatttgtcttatgtggttcatcagattgagtttagtaagcagggaagtatttctccttgtgtagctagtgcttgtttattcttcccttattaaaaaaaaaagagagaaaaaaacaaaggattggcatttttcttttatgaacgtggactgtagggagataaatagccctgcgggagaggaaggtcaagttcaaagtttttctttcctttggattcaggaataagcaaatggaaagactagccaaacaacccagcagcaggcatctgatggttaagccctccccccaggactttttatgtacataagcagcagaagtcactcgcgcagctgcggcgcattagttccaatagtttaacaggctgctttgtagcacggacaaagccgtgcgagcgcggtgctttccctccttgttcatttgctatgcgagcttgtcagtgatctttggcaggggcttgggagaggaggggtgacgtttaatacgcttccgcggaggagtgcgctcgcctcctctgcacccagccccaggctctacagagagactgaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatggtaaggtttgcgcagacctcgcagaaatggtggccgtttcccttcagggagtcctgctctcgcgcctttaattttgggggtagggagggaggaccatcatcattcctcaccggggatttatggccaagtgatctcccttaaccataaatcccacaaatgtccaagtcagggcaagaatcctggagactggtactaggagtggttgaggtgggtggttctcaaagttcaattcctattgcaagttcctacaagaaaattggatgccagatgtcaaataagaatgcagttttattcccatacgtacgtagtggcgtttctttgattccttaaaccaatttccctgccagcttccccaacagctgaggaaagaaaggaccagaaatgaggggaggaaaatcatagtttgctctgttttctgcatgatccccacttggacagagacacatacagtgtgtgtgtaatggtggtgtgtcttcataaagcccttcctcactcctgactttgatatacagtattcataatcttaaacatgcctttccaaaggaaagaagaaagggattaggaattctacgcagaaagttgcaggctggtacttggtagtattgttgtgttctttgaatttggattgttagaacattttgccaatctttttattttctttgtgaatatttttatcttctttataatgggtgaatttgtttcatgcatatgcttccatgtatttttctggaggattcctcatcttttcctgctcttggaaaaaaaaaaaagaagaaaaacccaaatattaaaacagaccatcatgtgagcttatttggagtatttggagtttctgcctgagtagaggccattccaaactctgatcagtgagtccaagtactagggtctatgttacacacttagataatttcaggtagtagtaggttctatacattacatctacattttgataagatgagtataaattatgataaagaaaacataacaaaaaagaatgagtgtgttagttgagaaactgtatgactaaataattttttacagttttgccataactaactaaacagtatgtacgttagcaatgggagggaaaaaaaaagcagaaacaaggcttttaggaggaaagcagcaaaaagtaaaaggaattaaaacctaaaccagtgacaagaccgtgctcaggaatgcattgatgttatagatgaaagtcaatgacaaaggaaataaaagccatgtcacacccaaagacatgaccaacctcaaaaatttggttttaagtagctagatctctgactgggaaagtgttattgtccccaggattttaacacctagatggcatttctgagtttggtagatgtaatggccataagaggagtgagacaaacattgactttttctgtcttaaagcagttattgggaaatgatggcttctctttgaggaagattttctttttggaaaaaattgtgagcaacaaacagtgaataaaagaaaggcatgaataaacactgggagatgcactgaaggagaaggttggctcaaggccaggcatcgggtgccagagcaggagagctggcatgagttcctacggagccaggaccagaatttccgtgtccagtgtcccttttggttgcgctgctttatcactgcagttcctaaattgcacccattgctgaatgagtggccctcaactcagctgtttgatttcagtctgagtggagcaacctagagttcagctggaggttatctgaactatttagacatgtcgggatgtaaggaaggcaggaaatcccatgaaaataggctttcttctgacatttctggcacttccttttctggtgctgtttggaaaaacttcatgagcacaatttctatcaatatttcattttagtgtatcaggtcacagcccagtaagaaaagcataaagagagcaatggaaaccagaaataaaaatcatggtatcgattttcagtaactcagaaggaagcagtttcccctatggactaaaactatcaggcaagggagttggaaagagtatctcaagttttccatattggttgaatgagccccaagacgttcataatatccacaggcatcttttgacaaaaatctcatttgtgctttcacagtttgtgctaagcactatggagaattttgaaaatatgtttcaaattgttctgacataaatataaatatatttgtatctaatttgttgctagtacagtgttctgcctcacagtttcctgctcctggtattcccctccattcgctatgcatacacttaatacctactgagtctaacatgtttattctgtacctaattattacaaagttgagcaagaaccatttgttggtttccaataatttataccatggtagaataaatcaataatattggaagacatctgttttagctaagataatcttgctgttctacaaaatagtctccaaatctcattggattgacacagtgaatttttatttcttgcttctgctttttgtggggaggcagcctgccctagccactgggtgcctcagggacctggaattctaccatcctgtggttccattatttgcaacatgtgattcccaaggttgccaggctcagatgaatcaggagaaagaccatgaaagaggatggtatgtgtgaacttttatgagacaggccgggaagtgcacatgtcacttatactcgttttcttctggctggaactcagttctatggccacatctaactgcaaaggaggctgggaaacatagctctgttccaaggcataaggtaaagtgctggtggctaatctatcttggttatatagtatgttaagggctatctgatttaccctctatgccatggttgaattcttagaataacatctgtaataacatatgccattgttgaattcttagaataacatctgtaataacaagtccttgaacctctcgtcaaacctccttgatgaagattatacagaagcacttctgttgtttgatagggctgttgattggaaagaccttgcttctaaacagtagaagtctccttccctgcaactatcatccatggatccaagatctgctttgggaatcctacaacttgaatttttgctcccttccattatgaagccctaaggcaagtggcttggagtaacccaccagagaaccagggccctattcattcattttggtatacccatgcttggcatgatggctggtcaatggtggaagcttaataaatgtctgctaaacaaattcattaatcaatattttagtgttctcatgctcttaaaaaagacttctcttgggctaagcatggtggctcatgcctataatcctagcactttgggaggctgaggagggcggagtccctgagctcaggagtttgagaccagcctgggcaacatggcgaaacaccgtctctactaaaaatacaaaaaattagccaggcatggtgatgtgtgcctgtaatcccagctccacaggaggctgaggcacgagaatcacttgaactcaggaggcggaggttgcagtgagccatgattgtgccactgcactccagcctgggtgacagagcaagactctgtcaccaaaaaaaaaaaaaaaaaaaaagggacttctcttttcttaagtaaacatcctgttatttcatttctatatgctatatttaccaggtagtttttatctagacttctcttgggttttcatgatccatttaaagaatagctactgaattgacagcatactctaggtgctatgtcactcagcaccaaagcagttagaaaagagactaaacttaaattcttactttgcatttagtaattgtgtgactttggtcaagttacttaacgtgtgcttcagtttccccgttagtcagttttctgggaatagtatctattgggggttgtggtttaattaagtacaattatgtataaattaagtggtttcacagggctggacccttagtgggtgtcattataagctagtattttttttattatgtactctgtgcccattattccagccttggtctgcatgaacctttaggatcatgtttaaatttctagatgattactctgtcagtcatttgtggatgaattagagtgaagagacaagagttgaaagaaacgagtgtatgtcagttttattactgtaggaaaggagaaggcagaaatgagagatactactgaggcagaactgtggggtttggtgtctcttctctgcccactgcaaaaatacatctttcaaattcctggttttcctaaaaggttcctccagttctcccaactggaagtaatccgttccttccttcaaggaacagatttctattgcgcctcttgtctctgatactctcaatgcttattagtaatagttttatcactagctagtatgtgttgagcactggttttggtctggcaccatctgttaggattagaattctcttgtgtctctgcttttcactaatctgtttgactgcttttactaaacatgcaatgccttgtagttctagtgattatagacatgattcagatttcatctggtaggggattccctctatcatcagcaggaactacaaagtcaatggaatctctggtgaagaaaacttaacttccagtactagtttatttcaggaaaattgaaatcaggaagttcttcacattcttcaggcttttctcgtcattgaattttaagcacagttttggggtgtaaggcctaaataagttttagaagaacaaggtagaaatgctggttttcagtctttgggaacttaaaagttgctgtttagtcatatttaagtcataaaacctgttatcttcacatattcttttaaaaagtaatttagcattataatcacttaagttataattttttcatatttttataatacacatctatatatccacgactcagatttttttttattttttattttattattattatactttaagttttagggtacatgtgcacaatgtgcaggttagttacatatgtatacatgtgccatgctggtgtgctgcacccattaactcgtcatttagcattaggtatatctcctaaagctatccctacccgctcccctgaccccagactcagatttttaaaatgccaaaattttgtcattgtttgcatcagttcttttatttttttaagaataaaatgttacagataatgtctaaagctgtcacccatcctattcttcttccttcgcagaggatcctgaaatcagtgtgttcttccttgaatgtcattgtcttttaacttcatatgtatgtgtcctgtttgtgtgtttaccattttatatatagagatggtacatgtatatatatctccataatatgccatactataaaatgagaaagagcaagctatatatatatatatatatatatatatatatatatatatccttaagcagtttgctcttttttagtacgtagtataggaatagagttgtgaatatatatataaaatatgtgtgtgtatatatacatatatatgcatatatgtacctatatacatatattatatatacctatatgaacctatatacatatatacacatatatgaacctatatacacatatacacatacgtacctatatacacatatacacatatgtgtacccatatacacatatacacatatgtacctatatacacatatacacatatgtgtacccatatacacatatacacatatgtgtacccatatacacatatacacatgtgtacccatatacacatatacacatatgtgtacccatatacacatatacacatatgtgtacccatatacacatatacacatatgtgtacccatatacacatatacacatgtgtacccatatacacatatacacatgtgtacccatatacacatatacacatgtgtacccatatacacatatatgcatatgtgtacccatatacgcatatgtgtacccatatacgcatatgtgtacccatatacgcatatgtgtacccatatacacatatacgcatatgtgtacccatatacacatatacgcatatgtgtacccatatacacatatacgcatatgtgtacccatatacatatatatacctgtgtacctatatatacacacacacacatatatatatctatatacctacatatatatacacacatatatatatacctggatcattttttaaaatgctcaacagtacacacatgtaacagcatttcagtcaatggtggactgcatatttgatggtggtcccataatattataacggaccagaaaaattccaatcacctagtgaagtcatagcacaatgcattaattactcttgtgtttgtgggcatgctggtgtaaacaaacctaccatgctgtcagtcccataaacatatagcatatatagttatatattatacttaataataactatgttgctggtttatgtatttatgtattttaccattgttttaaagagtactcctcctacttatatacaaaagttaactataaaacagcctcaggtaggtccctcaggaggtatctagaagagggcattgttctcataggagatgacagctccatgcatgttattgccccagaagagcttccagtgggacaagatatggaggaggaagataatgatactgatgatcctgtccttgtgtaagcctaggctaatgtgtgtttgtgtcttagtttctaacaaaaatatttagaaagtaaaaaaaaattaaaaataaaagcttatagaataaagatatagagaaaatatttttgtgcagctgtataatgttagtgtttcaagttaagtgttattacaaaagagccaaaaaattaaaagaaaattaagagttgtataaagtaaaaagttacagtaaccaaaattaacttatatcaaagaaataaaaatatttataaattaagtgtagcctaagtgtacagtgtttataaagtctatagtagtgtgtggaaatgtcccaggccttcacattgactcaccactcactcactgagtcacccagagcaactttcagtcctgtaagctgcattcgtggtcagtgccccatacaggtatatcattttttatcttttatactgtatttttaactgtaccttttctatgtttagatatacaaatacttaaccattgtgttatgattgcccacaatagtcagtagaataacatgctgtacaggtttgtaggctaggagcaataggctataccatctaggtttgtgtaagtacactctaacatgtctgcacaatgatgaaattgcctaatgacacatttctcagaacttagaataagcaatgcacaactctgtgtcaatttgcctctaaaaacccagctgtttatactcttaaaatattgttactatagctgtcagtatcacactccaatctaagtgaatgtcacaatgaaaaacattgagtcattttactataacggaaatgaagatgtaatttcctgaatttaacagtcaatttaggctacatagtgaaatattttcaagctactttgaaaacattaaccattaaaaactaatattcatgggtagcattcactaagatgcatcaggtttgttatttatgatatatctctcaaaaacatttttaattccaaatataattaaaaccaaatacagttttctaatataagtaatttcatggggattatattcctgattaaggactagatgaaaacattgtcaatttatactgtgctcgatgcactgaatggaggaaaatgttccagcgtgtatataagcgaaattaggtagtaggatatctttaggaatcatggtgactaggtaatactcaactgtataatttttataattcttgtatacacatatgtatttttaattaaaacatatccaacagtagaagaagtacttagtaacaatcttaacaacaaaataatttctttaggtggactttcaaaaggccttttaggagacttttaataaatcttaaatgtgtttaggaagctaaataagtgattttggccatattttttgtttactataaatttctctttatcaggcattggcattagatgtaaagttgctcatatttaaaagtaaacatttgctttctgagtcattatttcttcagcaactgtagttgtttttatggttgttaagagaaatataaatttgcaagtcatagaaggggaaagaaaccatttgtcacctataaaagagaaatacagccacttagagtttgtagagtaaaaatacacatatacacacacaaacaactgagtagattttcaaagccattatttagtgatttctctttgaggtctctttctccctcgttccatctctcttacttctgccctgcttagctttaaggttatcttttctctgtctcttatggtaataatacccggagaagagcattgctgccagtctcctgggaactaggaacccagaggagggctgtaggcaaagtgtaataccagaaggtggggagcaagtttctgggggaaatcatctgagaagcacaccaggaagtgctgctggaatgtttggggaagaccagtcagccctaaccttcagccatgtctgtggcataactggctgttgccctctgtggaaatcatgggaggtggaggcgctgcaagttgagggtgtctgtaccatttgaaaggcatagttggctttccacgaaatcaaaagacctgaggaagattttccttttaaagaacatgccgattggcttgtcatgtttaaggaattacagggattacattatgacaattggcattgagaaaaaagtgaagaaaaccttggataaccttgcagcttattattcacgtgtgcttcccatgaccattgacatttatcttaaagagaaaagatgtgaagcctgttcgtacgagctgaagccgttgctactgatggtaaaatctcttcttaagaagacatggtctttcttgcaaacttggcagaaatgttgataagaagaaaataaaaacttgaatcttaaagttcattaaaataatgaaaatcatggctttgattttttaaaaaatattctttgtgtaaatttctttataattgaaaagctcctatgtattcagataactaaaggagtttcagcactttttttttcttagatagaaagctaccaaatttgttcttcaagtagcactttcaggaagaagctttactatctctaatgtagcaaaataatgtcttttttttaatggttttgctttttaaaaaatcatgtttttaaagctgcgattcattcagtatattgaaatcacatatttccaggtcttctggtcatttgatacttgaccttagttattcaacctttttgacttggagactctattaataagtcatatggttataaaggcatttggcatttacaagtaaaaagtaatgactaattaaatttacaaagtgataacaaactacagtctatttaagattagcaattagaaacaagttccaacttgctgctgtaagaaagtaaggtagatgctacatgggtaaaaacaggaaacagaattatttaataattctgtgactcataaataggattcagggccttcagaatgaaggtattggtggtattcacgttaggccaccatctgaaaggcataattttaggtaacagatagggaaatgtatagatcactgtaaagattctaatttaaaattctcttttactagacttcaattttataccatcttaacacatcagtctcttctactgtaaataagcaaaacagaaaaatcattttatgtgcagttttaaggacataaatactctccaagtatttcagatgaggcacttattctcaaaaggagatcttgaaaagttgatctgagaagaaattacatgatttcattttggaataaaaacacttaggttcataataatatagctttataaccttagattaattataacatagacgtcaatgatttagctcctgccatgtgtcaggtactttgtgtacattaaccccttaaaacaaccaaggttggatgtaagtattgttaaccgtactttacatatgcagctgctgaggcccagaaaaagttcttacataaccaagatctttcagctaaacagctatgaaaccaatagcattaaaacttgaacccaagtcttcctaactctccatcgtgtgttctttctttcagcattaccttcctttgggctaagaatcacattcacatttgttaccctaccctgcatgtgtattgaagttataacaatgaatattcaaagattttacaaaatagtagttaacagaaaggtagagacagagcccttttttggtgtggaatctcagtttattagtttacacatgtggcttgtatagaagttgacatccttataaaatattcttataaaaatatgtgtgtgtaggagaaatatatgtccttggtgaaaaggggtcaatggagaacatttgattcagggttgtttttacataagaggtgtaaaaacaaagccagccagagaataattttatagtcaatcattcagggaaagaaaaaagtcttgagctctaaggagaaagatcaagtcagaaatctgttaaggtttgactctggaagagccagctgggaatgatggccggctagttcaagtcactaagcaacagaacagcaaactgcttggtaacaagatctggcctgactcacaggctctctttgagtgacctaggtggccagatagaggaggaccaagacccatcttacctcaaaacaatatccttccatttccactttgccagccttcatgccaaattccacattatagaatagtctctttgacttgagatatttccttttagaatggaaatatctctgggactagaagctaatattgttgtctttcttctcagaaatagtgtttcagagattgttttctgtgattcaatatattatttaaaaagtgtaagctttaataagagcaaacaaagtggaaacatttgagttggtggtctgacttttggttttcgtaagcaaatgtatacagggccaaaactacctaccttcattgggtgcaatctttctttccttgggctctcagactgaatgtgttgacatttatttgtcattttctatgttatgctgtcttctagttcatgtttgtatttcaagtatgtagctggactgtaagttcctaaaaagtaagaaccggccgggtgcggtagttcatgcctgtaatcccagcactttgggaggctgaggcacgtggatcacttgaggtcaggagttttagaccagcctgttcaacatggtgaaacctcgtctctactaaaaatataaaaattagctgggcatggtggtgcatgcctgtaatccgagctactcgggaggctgaggcaggagaatcgctggaacctaggaggcggaggttgctttgagccgagattgcaccattgcacaacagaggagataccatttcaaaaaaaaaaaaaaaaaagtaagaacctccacattcatcaatcattgtatccactgtgaaggtacaagtgccacctgtataatatacattcaataaatagttgttttttgatcgattgagaaacataccttctgttgctgtgtcttttatgctgaacacccagggggatccatacccttccagactagaagtcctggtgatgttggttttgattgccatagtggaaaaaaactttgaactcaatgattaaccatttgtgtggactttgtcaccatgactcagtgtgtgtctctgtgtgtgtgtgtgtgtgtgtgtgtgtatgttttgggtttacatgcacatagattggtatagttggctttggtgtatatgaatgattctgtatcttattattctgtcacaataatttgtcaaatacatgcattttaatatttagcttatactttgaaaattatttatgcctgttatatttctgaaaaaaatctgtgtaaatgtatctatgattcttgggaaattactgaataactagcttgttaaattctgatgactaatccttatcttttagaattcataacagttaaattatatatcaagacctaagcttacaaaagaaatgtcaagattttgagaaatttgcaaaaaaaaacccttcatagtttcattttcagtgttttaatttggagaaattttaactggcagaaattaagtaccatttttccaaagtagatcttcagaagaactaaaataatagaaaacctttttgaaggggtttagcatagaaatattattttaatataaatatttttatacagttaaatattatatatatcatttttaaattgcagtaatttgagaccaatttttccccattacccttttgagataaccctctgattaaattagctattattaaaataaagtggcttcctcttcatgttattagtagggtaccagttttttggtttttttttttcatacatggctaatttcacatttataaatggtgaagtgtgtattgttgaccttttgaagcaagcaactttctgacttaagattacttggattatcattcctgcttgtttgccttctttaggttaatagtatttgttttactttgctttattttgtgcagtgtgattttttttatgaccttctattgagtgattgccaaatagaacagcgtatgatttatggatactaataactaaaatatatatgaattgcaggctgataatgcacaaggctgatttctacagttctcctctgaatagaaccaggcttcctttaataaagccttcttactaataagaatagcagtttcactaacacattgatcattcttgaatcaccttcacaattttaggtgcaactgtgggccatttatactgtttacatttaatatttctagtagacttacatttttatttaaaaggccatatgtttaaaaataaagctttgtatattactgtaatttggaactagcgtcatttattatgcatagaagataattgaaaaaatatacaataaacaaggcaaaatagattcaagtttagctagataaccatgaccttccaaagactctgagcctgaggtctgttctctgtttaaaatggcatttagcaaataatatagacatatgaaagaccacaattaagtctttcttcttaaggtaataagaattactgaaagggatttggaaaggaaataagcttctccttatttaattcaacattttaaaattcaataagccacatcagctatgccaaacaccatctttgtacaacctcaaaccatctaatataccaacctgaaccactgatacttccaccataggaagagggacatttgttcttgcagaagttcttctgttctcaatcccttagttgcaggtaaacacactgaacttggattgggtgatgctaatccctaagcagaaagtatgttggtactctgttttcccacactgtaattattaagttcttacctggtagctgcacagatgcaaaaaaaaaaaaaaaaaaaaaaaaaaaatgttctgtggaaaattctgtacctgccaatggtagattccaagttttacttccaaagagtgtaaacatgggtgttttaaaaagtatgtctcaatgcaaataaatgagagctaagtaaggaaccacatttttctaccctgtaatcttttttactctgtaaactaattactttccatgctagaatgctcacacagcactggctacgtaatttgtagggcccaggtaaagtgaaaatacagggcccgttacgcaaataaatattacaaatttcatgatggcaacagcactgcattcaatccagcacaaggcccttctgagagtaggatcctgtataacttcataggtcacacctgtgaagccagccctgcacccacaataggtctgatgtgatgcccagaaagtcgactttgtaagccctacaggtgatgtggaagccatacgttgagaaactgtcttaaagggacatctttttagacagtctcactctgttgcccaggctggagtgcagtggcacgatctcagctcactgcaacctctgcctcctgggttcaagcaattctcctgcctcagcctcctgagtagctaggattacaggcatgcaacaccatacccgcctaatttttatatttttggtagagagggggtttcaccatgtttgccaggctggtctcgaactcctgacctcaagagatctgcctgtctcagcctcccaaagtactgggattacaggcatgagccactgtacctggccttaaaagaacatctttattcataagctcctcattttacactgttgatagaaacttcagaagacaatgatatgcgttgaagtaaaaaaacagaagttccaagaaaagtcagagttggaccagctataaattaaagagaaacattatcttacattcatcttgagagttttctttgcaaatgaacacgtacatacacaaacaaacttaaagcagcattgcctttgcatttaaagtcacttactgatatgcacagtattagtcatggcaaaatattattagcatttgaaattgatgctcatccctctttgttgatactgtctcatttactggattaactttattcatatgagatctcccttttcttttcattgtctctgtttccagcaccttaattgaaagtacccccggttacataattattcctttgaccttattcagtatgttccctgcaccacaagtgtctctcctctgttcaattccaactgtcagctcttttaataaaccctactcttaaacctcatttcccaggctcaagttccatatgcctcctctggacatttccacgtggaagatccactcttaatttatatttaacacgcacaaaaccaagcttactgtgcccccctttttgatttttctacttctgtttatctggccattatcttcccaaaaaaccagaaaaaatcatatttgacttctgccttgccctccttctgcctaggcctatggattatttcacctattatctcttgctgttctgttccctcccaataccaccaggtattttaatacttagatttgtgtttgatctatttcaataacattctaacttgtctttgtgccactagctccttcccactaaggatgtcctacttatactgtctcattaattaccctacagttctgctttgattgtccactatctatagcagaggtgaacaaaaggaccagaaaataaatattttaggctttgcggaccctatggtctctggggcaactattcaaccctaccacggtagtgcaaaagaagcccagatatacaaatggacattagcatgttccaataaaactgtatttgcaaaaacaaataggctgaatttcgcccactggccgtaatttgccgatccctgccctgtaggataaagttcacacctttaacatggcatctaagcatctgtcatcagttctgcacctatctctgcaaccctatgtgttattgtgtcctatggatacttcacatccttcgttttgaagccgaatctagagcagggttgctcaacctcagcagaactgatgactgggccagaatgatgctttgtggtgggggctctcctgtgcattgtaggaggttaagaacatccctggccactgcccactagatgacattaatttccaccatgaggtgaaaattcaaaatgtctccaagcactgccagttttcccttgtaggggacgagggattgttttcagttaagaactactgccctagggagtaaattttgtgaaggggagaaccagttctacctcattcacaggtgtatccctagcacctagcacagtcttgtgatatacaaagaggttcaggaatctattgcatagtccaactctgctactcactgtgggatcctagggttatttaaattccacaaatcacaattaagttcatctgtaagtggaactattactaattcatacatgtttcataaaattatttagaagttcaaatgatatatttaacaaaaagacctcttgaaagacagtagtactttcaaataaaaggtaaacatacaattgatagaacactgaaggtgatctgagcctattgaaatctagaagcttaatttgactcacatactctgtctacactgtacaaattactatatgggatgttattggggcattgtctttgttctcaaggattatgacctaacaggtgttagaatatgattactcaaccataaaacaatagttgccataactaagcataaagagtggttggaatttatgggagggagacattgtatctggtactaggaatcacttaagacctcatgagtgagatgaaatagtcacagagaagtcccaggcaccctactgagcattgtcttagatgatctcattgaatattcactgcaacttgattaggtttaggttttattatcacatttcacaaagagagaggggcctaggaaggaatttgatatgaatgtgaagcatgggagatttcagcagggagagaactgcagtgaagtgtggaaggaggggaagtgacaggaggtgttttctcaccaagggaatagtgtgaacaaatatggggattacatggggtttaggtgagtttgagtgcctctagggaaggtaggttggaatcagattttgaaggattgctaacatctctctctctcttgctctcgcttgctcgctcgctcgctctcacatcacacacacacacacacacacacacacacacacacaccagggatttatatgtataaaagaaacatgatgatgttatctttcctaacagcttcactccacataacaggaagtgacattttgagttcttaccccatgctaagcttgctaagccacaagtatgtgcactgaacactttcaatagttggactttgagactcagttcaattagaccaatctataccatctttcagctagctactgctcttctacttttcccaagataatccttctgaaatagatacacaatgctgttttcattcaaatcagatgtgttaattctactagtggcacttgtgttctgatgcatagaacagaggcattatttacgtgaggactgtgccttccttcttactgaattgcaaaagtatacaattcttagaacacatctagcagttctgaggggctggacacagaaaaccatcttactctgaaggtaattttctctattttatcactagctcaccaaggtgagagtcaggagtgaaatatcctattttcttttcatccattcaaaaaatagtttgagtgtttcctgtgtacctattgttcttctggagatagagaactgaatgaaatagacagtcttccatacattggggcatactttttttttttttttttttttttgagacagggtcttactcttttgtccaggccgcctagagtaaagtggcatgatcactgctcacctaagccttgacctcttgggctctgggttcaagaggcctcccacctcaacctctcaggtagctgggactacaggcacatgctaccaggcctagataactttttattttttgtagggatgggggtctcactatgttgcccaggctggtctcaaacttctgggctcaagccattctccagcctcggccttccaaagtgctgggattataggcatgagccactgcatcaggctaaagagcacatattctaataaaggagaagacaacacacaaataaatattccagtgggtcagagaaagacaagtacagtatagaagaataagtcagggtaaggagttacagagttgtatgtaagacatttcagcagagatctgaaagagatgactgaacgagctatatgattatccagcagaagtacatttcattgtgatttcaagtacgccaaatgtggttggcgtatttgagggaggggggaagttatagaaaatgaggtaggagccacagaaaggcatcagatcacatagtgctttgagcctgtagtaaagacttgggtcattccttggtgatgactgtgatgtattgaagcaaaaagtgttagtagtaggaatgtctgtgttaggaagggacacagtctatcataagttttggaagaatcatcccggctcctgtgtagaaagtaaagatgtggggaaaatggaagcagagaccagttaaactattgaagtaacccaggtaacatgtattggcagtgtggactagagaaatagaggtaaaagtagttaaaaaaaaaaaaaaaaaaaaggtcataattctgtctaccatttgaagacacagccaacagaatttgtggatgcattggatgtgaagagtgagaaagaagaatcaagaataactcttaagtttgtggacttagcaacaggtagaatgtagttgtcatttgtcaagctgaggaagattgtggaaggagcatttttaggggaggtggatcaggagtttagttttaaaaaatttattttggggatgcctcttagatttctgcatggaggtttcacttagataactgaatgtatgagtctgaagtttggagcacagattagcacttgagatgaacacttgagagttattaaaatgtaggtggtattaaaagtgataagtctgaatgaatcacccagggagcaagtatatatagagaaaagacctgagacagttggggcactttaaaatctagaaatcaggaaaatgaggaaaactcagcagagaggccagtgaggttgaagaaaaattgagagtgatatctggaggccaaatgaacaaactgtttcaggagaaataagtggctgggcatggtggctcacggctgtaatcccagcactttgggcggatcccctgaggtcaggagtttgagaccagcctggccaacatggcaaaacctcatctcaaataaaattacaaaaatcagccaggcgtggtggcaggcacctgtgatcccagctactggggagtctgaggcaggagaatcatcacttgaacccaggaggcagaggttgcaatgaactgagatcatgccactgcactccagcctgggtgacagagcaagactctgtctcaaaaacaaagaaacaacaacaacagaaaagtgataaactgtggcagatgctgctcataggtcaactaaaataagaactgagaattgatcattgcattggcaacatgcagccaattggtggcatacaacacaagtcgatcagtagagtagtgatgatacaggactgactagagtggaatataacaaatttccccaatgcttaaaccaacaagcatttattattgcatacagtttctgagaaatcagggagcagcttagctggctggttctgactaaagttcctagaagaaattgcactcaagttgtcagtgaaggctatagtcatctgaagctgtatctgggactggaagatcagttttctaagatggtgctgtccgcaggcagccttgctttacactggctgttggcagaagacttcagttcctcactgtttgtgcttctccaaagggctgggtgttcttttttttgttgttgttttaatactttaagttctagggaacatgtgcacagcgtgcaggtttgttacatatgtatacatgtgccatgttggtgtgctgcacccattattaactcgtcatttacattaggtatatctcctaatgctatccctctcccctccccccaccccacaataggccccggtgtgtgatgtcccccttcctgtgtccaagtgttctcattgttcaattcccacctacaagtgagaacatgtgatatttggttttttgtccttgcgatagtttgctgagaatgatggtttccagcttcatccatgtccctacaaagcacgtgaactcatccttttttatggctgcatagtatttcatggtgtatatgtgccacattttcttaatccagtctatcattgttggacatttgggttggttccaagtctttgctattgtgaatagtgctgcaataaacatacatgtgcatgtgtctttatagcagcatgatttataatcctttgggtatgtacccagtaatgggatggctgggtgttcctacctcaggcacaggagtcagtgattcaagagagtgcaaagtagaagccacaacgacttttatgacccagacttggcagcaacacactattactctgccatattcttctgctcacatgtgccaaccctggtacagtgtgagagaggactactcaaagttgtgagtatctggaggtgaaggcctccttataaaaggactaagtcaagtggattcaagagatgatgggaaaagaagtggtggcaattgttaactcttggagttttgttgtaaagtcagttggaggggataggaagaaaaatgagatatgggcaaagggtgtgttgtcaattgtattatgtttgtgtggttttgagaaagaagcagcagaaaggggacatttgatcatgagaaactggggacaattgcaggagcaatattcttgaggaggctttgggggaataggggtaaggagaagttcagatagtgcacaagccaaggagttgcccttaatgggagtgctgattgttcagtcctcacaataaatgagaaagaagagtaggacagtctgagagtataggaggtcagtatcttgatagatctggtttcagagtgtatgaaaagtgtctcttaattccttctattttgtgataaaataataagctcatcaatgtaaagacagagaacagatgttggaggtttgaggagagagaaggtgagaaatgatccatcatctctgggaggagagagtgctttgtctagagaaatgtgaaattcccagacggcactaaggagccacctcaggccagtagttacaaattcaaagtcatcatggttgtgtttttcctcaactatcattgactgcttaggccacaacaagcacggtttgaaaaaggttggtttaacagagatgagatatttcagtgaagtctgagttttaaaaggatatgcaaagaagtgattatgctgccatatttactctaagctcactaaggaaaaggggacataagtttggtgagggtcagaacaacttctaaggtcaatgcactggaggactcattgggtttggaagatttttggagtcagaatactggaggggatgagctagaaagagagaaggtagggagagacgcttaacagtggttatggggcaccgttatctgtcatggcaaggccttgcttatggtaaggaaaggaggtttcaggtaagattatctgaagggagatccagaaactgggagaccgtgggaggaaaagataattatgagttatgtaagagtttgcgctggagagagacagggctaaaatgtttaaagactgagaggagagacctttaggtcagtagaaaactggattaggaggggagcagattaatgatgtgagttacaaagacattttagggcaaggaagagatcatggtctggaagcagcagagaagaatgagaaagactcctacttcactaggggcagaggtacaaacatgtggaaggaaaaatagccactgcatcagagggctgaagtaaatccgtattctcggtgggcagccagtagtgtcagagcaagatggtgcaggaaagtcagagaacatgctgaagatacaggagcataaggagattttgctgatgacagactgaacgctaggagtcacgctggcgagtttgcaggaattggggaaggctggggatttcaaagtaggggatttacagagccatctggtgatgagcaatgacctggcagtcttggactttgtgtggtgacggttgtgtattcaagacaaggaccttggttttaagaccatgtagtcagacaagcacaaactcctctgctgggatggccggtttctttggtctatttaattagttccagaaacagtaattcatcctcactgcatttatagaaattgaggggagaggtggtgggtaccagactggccaggtctgcccagtcatcttcacttcaacattcctgtctggtaaagtcatattattctcacatcttggccgtgtgtgtatgctccaagaatgagacagatgacagaagatacagaaaaacaattgggaaattgctagtttgcagatgtatagccctggcacagattttctaatatgaaattgccattttttccatgatttggacacaaaatcctgttcttgaatatgatgttcagcctagatattgaagaactgaaaaatatttttgaaaaaatatatatattgcatttgtcacaacagtttatacacataattatcacaatgatattgcttttcttaaataaataggttttatgtgttggcatgaaatacttttacaagatgatgccaggttttaacatttatacaggaatattttcattatcataattgttaataaaacaaatatgaaatgtatagctttctctttggagtttgaattgttggttcttactgcctgcttgcatatttatattagttgtactggctggcagttattaggaaatacgatcttctgtgtcttaggagtgcgccctgcaagcaacatgtgcaaacatttttttctttctttctttttttttgccctaaggaaaagggtaagctctggcaccttttaacctgtaaggattatgtggctcttgctgtgattgattggttggcttctcctcaagaaatgctcctggtgcgtattttatgttctcacagagccagggctttgctgatcagcacgtcacccctgtcaagacgtgggcttgcttttgtgcatttgctcttgcagcctgggaagcatatttcaacacactgtccagaattggctagaacatgcctgtcactcccagctgactctgatgacgctcttgccaacgtagatttacatcaacacagttctttactggaaaaagctcattcagaatatacagggtggcccatttaaaagaggcatagcgtcaatttgaagagaaatatattttaaagggagaactctaagaaatacacagtcaattgaaggctccatggagcatagaattataactagcatcacccgagaatttttcccctggagattgtcctaagctctaacttctagagactggcttatcctgaaaagagaacctttctgttctagactttttctttcagcatgctagatatgtaggcatttttagcctcttctttccctaaccatataatctgaacaccatattcattgaagaaagcatgagatgtgaaagctgataagatgcaggattatgtgacaccattgctttttacctgtgcaaaattcagtttggtaatcaatggaaatacagattttacccttcacataaaattgtttggcatatgtccatcttgttttttgactcatccttgatatcacaatgaatgtttgggataggcatattactcagatgtgtgggtctatagacaggaaatcaggcattcagaaataaagcttgttaccatagctatccaggaaaaaaatacaacactgtctttgctgtacaaaagaaaaattcaatactactgtcacatgatatgtgattactattattatgacccaatgctactcacccttcattttcatcattctagtctatttcaggtcattacagtaatggatacaactgaatgggtttgtaattttaccccttctctcatgacaaccagcaggattctcaatgacacatgctttgatctgtctgcttttaaatctcttaagcagggtggctctagatagcttcctctcagaagattttatgattctaatagacctcatgatgagttctatatttgtgcttgtttagatacatcaaagtcaggctttatactagggccacctggaaagttaaggtcatcagctttttgttatagtcattggattactgtgatgctcagcaataacaaagtttgaccttgtaaagtgatcaaaagttgtgggttacaatataggaatattaaagtatattctgccatgatgtgtcttctgttgtagtttgtctagaattaatattacagtcacaattaactccaaagtgttctatactgcttgcatacagtacagtgggaaagaagagatgtcaaaatcagagaaataagattcctccattatgaattaacatacaaaatctacacttaatgcatcagaactaagatgcaatgttttaaagagattgagttgacaggtcaatcagatggtaggactggtaagaatttgagcaggcataaacaattggcagtatgtattcaaacactgtttatgagagtgaggaactattggttaacaagctgacattaagcatttagattatataaatcaccttattaactgcattctatctatggatctattatcgatctgtatctatctatcgatctgtctgtcatcttttgttttgtctggttccatgcttccaaagacattttctgatcttcattgttacatagtactctctactgagtcctaaagaacacagttctgtgtcaggctgattgaagtgtaatgatttgagtgatgattgtagtgctcaatgaaaggaaataaagaatatttggactctgttcagcagtcatatgggcttgtacaatatgagtctgcttttgagagaagaaacttgcacaaatgtctctttaagagcctgcttttaattcttttgggatatatatctaagtgtgtcttaagatagttctatttttaatatattttttcatactgttttccatagtggttgcaccattttacaatcctatcaacagtgcacgagggttcaatttctccatattcttgtcaacacttacgtgtgtgtgtgtgtttacagtagctatcctaatgggcatgaaattatatcttattgaggttttgatttgtatctctctattagtaatgttgagcagcttttcatgtacttgttggccatctgtatatcatctttgaagaaatgtctgttcaagttatgtactcattttttggtggagttatttaatcttttgtttctaaaatgttttgaatagatcaaggtttaacagtcattcctctgtgtgcttttatgtcatgtttagaaatgtgactccattttaagcttcttaaatctttttttactttaccattttttgggggctctctttttttatatttaacttttgtctatctgtaatgtgttttgattatgaagaataaggaaaaaatttagggtttgtttagcttcccaaaccccactttatagaataatcactgatcatgtactaacttataatacttgatcattttaagtaggctttgttattgagttccacatttggcacacctactggtgtaatgattgctctagtattagtgcaatagtatcgtgttagattttgtttgcagtgtgctaagtggtaaacctcagctattaatctaccttgactaaatatgtaattgttccctttattaagccctattttctttcaaaataaatattaactatgtttcccactcattcttttttgggggaagagtaaatataaagaaatgtttccagcaatgtgggaggccaatgtgaaagaatacttctatattatagaatgactatttttgcaaatgcaaaatgataacagaattcccagataaggaatagcaatgactgtttcagggcattacctaagtgtgtttcttgggctaaatttagaatgcctgattactgcacacctggtatgaaaatagaaaacccttgtgcctacatcacataatgcttaccacattgaggtacagataaaagaagttctagaattagggttgttcaaagcctggtttactatattttggatataaaatggagtaaatctcataatccttctgaacattggttttctcacttgctaaataggaataaataacatgcatgaatagtatagaatggttgtccatgtgtctaaacatgataatttgtggggtatgtactttataaatgattatatgcaaaaaggatggccagacgcagtggctcacgcctgtaatcccagcactttgggaggccaaggcaggtggatcacctgaggtcaggagtttgagaccagcctgaccaacatggtgaaaccccgtctctactaaaagtataaaaattcaccaaatatggtagtgcatgcctgtaatcccagctactcaggaggctgaggcaggaaaattgcttgaacctgggaggtggaggttgcagtgagccgagactgcgccattgcactccagcctgggcgacaagagcaaaactccatccacaccctaccctccccccaaaagaagatgatgatgatgatgatgatgataattgatatcagtaacaacaacagtaatactggtgatagaagatccttctggtgcaaaccattctcaacaatatgtttgctccagagaaggtagggccagactcctaatcccaatgttgtttaaaagcccattcagattatgaattcatttgaagcattttaggacccgagagactactagaagtttaccgttaaacttagatgacatacagttagaaaaattttccatagtcagctttttcttctcctgttatcttctgtattttactaagagaatgtttagttttaactactagaaaaacgtaatttcaggttgattaaaagagaagaacctagatatgtaaataaagatgaatcttttagacatgtagtcagtagctttcatgttactaatgaaaagttcttcatatcctatgatttgaaagaggaaaatcaagttttgtggaagaaaatacgtgaaattttaaataaatatacggcaactttatatagccagagttaattcttctttttcagtaaattgtattaccctgaaacaccaaaatgtcaatagtacaattatggtcatattgagagcacttgttattagacacaccctttagatttttttcttttgaatagaaactgcaagaatttttaaaaactgggcttattgactggacgaagggttttaaaaagaacagaaagacaaggcagggcaaatcctggtgtatttcacctgcgtagtgacatataggaagaagggacctttcagagatcatcttgagttttgactagatgataaaactgaggttcaggatggcacagaaaagtgtccaaggtcacacatttaggaaaatgtgggacatagacacaaattgtttgatgtagttcagtagtctttttagtctgacccagagcctttggggatggggacggaaggagattgggaagagcttgtcattgattcagtatctctgctcagtgccctcttgaggtttttgtttgtttgttttgtttttgtctttctggtatttttctgttgttttgatcctggatttggagtacaaagagactaaaccattttccatattgcatacctgactttgacttacactaggtgcattgaatgcaagaagcagttatgtagaaatgaattaatagataaatttactgtaaatctagacctttattgttgttcctcctatgctactagttagctgagtgatcacaggcaaattacttaaatcctcataggctcagtttcctctaatttaaaaggagagtgttgggtagttgatctctaaagtcctcttcagtgcaaagtgctgtgcttgcccctctttacctgaataattcctaagattgctgaagcatcattatctccttgttcttagctactgattgtatatttaattccacaattgggtttatctctattttcattcatgcatctttgtatcattaattccgaagtctcatataaaatctttaattcaaaaaattgagtgatggtacaagaaaagcaaactgcctatgaattccacgtgattgtgcccctatttacaaggtataaatgtgttaagaacttaaaagtttttgagtattgattattgttgccaagtcgtcaagacaatgcttataaagtaatccattatccttttccacactcttttcccttttagaacaaaaataccagcaagaaaaaaaaggatgactgttccaggtcatcaagaaagtagactacttggtcattatcaaaaatattttgaacatgtgggcactttataaaacaaagaataaacaatagaaaattatgtacttagaaagtccagactgttaataattttctgcacttaacacagtaagtgggcccacagacattaaggtactaaatgatttatagatgaatttattattcagtttcaggacaccagcagcaataaagtattttctacttttataaataactcatatggaacttttatctagtgatacactaactcttgtgttagaatgtgtaaagaaaatattttataatgcaattgtacagtgttggagtgattaggattcaaaccttcaacttccaatgagaattttaatacttagtctttaaaaatagtaaactgagatttatatttatgttatttcataccatcctatattccataatcttctataacatgattttatattcctaccttttattcaaccattctcttcatattggacattggctgtttttaattgttttaagataagcatacttgaaggtcaatcctggattggtgcattaagatgcattctcagaaatatgatgtatagagttaaagaacattttaaaggtgacatcgtgttctgcttttcagagactgttagcagtgtgcttgtagcgtattacactgctgtatcgctgtatcactgcaccatctcaaatattgagtttttttatagttaagtatttataaaattaatatgttggataaaatctaatttatctcaattgattaacattgaggctgcaaatatttttatagtgtaaaagaattttctattgtgaattgtacattagtgtcttattgagacattaacatttcctgtctttgttgttgttgctgttgttgttgttgttttgacacagagtctcattctgtcacccagggtgaagtgcagtggcacaatcttggctcattgcaacctctgccttttgggttcaagcgatcctctcatctcagcctcccgaatagctgggactacaggtgtgcaccaccacacccagctaatttttgtatttttagtaaaaatggggtttcaccatattgcgtaggtcagtctcgaactcctcacttcaagagatctacctgtcttggcctcccaaagtgctgggattacaggtgtgagccactgcacccagccctttctccctcacacttttggaaaaaatatttttctcagtttgttgcttgccatctaatttattacattgctttttaatatacaactatagacaaaagaatcacttttcttttggaaaatttgatctatgactttcattcatataaaagctttcctcaccctcaggtcaatgttcacctttatttttttctagttttttttaaactttgtttttaatcactgtgaaaataattgaaagatgatatttagataaaaatttgtgtaaagctctactattttgatacagattgaaaaggataaaaagaaatgagtaagaagtatgcgtagtgtttagaatgaacatgaatgataaactaataggtattattttacaaattatagaatattaaagataaatatactctagagtatagaaatatattttatattattatgttaaaatattaaatatttcaggcatgtaaaaatagatgatagtgtagccatttatgcatcaaagagttcaaaccatacaacactaaaggtaaaactggggcccctagtgtacccttccccaattctatcacctttccttcccacccagaggtaactactattatgtgtttacttttcttgagtatgttcttgaataggtgtgtattcaaaagagacagttcctttttgcactttggaaaacaaataattctgccttcccccccatgattgcattttatatgttttactaagatatttattataataaatattacaccacttttctctgtcctattcatggggaaaggaactctttttgttcaaaatttgtcattcttatattgtactgccccatattctgcaaatctgacaacagaatacattgtatgacaaatgtgatgtttggtacaaatatgtcagcttatgtatgctgttgcatgtgttgctcagcattgcgtgtattactgagcattgcatgtatcacttagcctgtctataaaaaattgagacatttatttaaataataattgtcccacaatctattcatgtttatgcatgtggatatttgaagcaaaatatgccatagaaacagtatctcttgctcactgaattttaaagtattttaacatcagtagcaagtgcataataaatctttaatgtataatacgaactgatagaaaaatagggctctgcatattttttcttgaaaaacaaatgtgttttgagaaatatagctttgtctaatgctgcctttgtaaaaccgggaagtcaaaagacaaataatattttgattctatatgttatgttgattatatatagtatgtatgtgaatgtgcataactatatggattcatatatgcacatatatacacattcatttatactcatgaaaatggtaaaaatccagctaatgatttaaacattgggtcaatagcaatatataaaaataatattaaacattcagatctttgcaaaatctaaatgggcttgtttttaattttcatgtggacatttgaaattttatagataagactaacaatatgttttactgtactgtgagaatttaagattaatgaaatattatgttattaatttcttacatttgtaaagttgtttttcacaataccgtggcctattagattgctaagaaattatgtatgtcaactctttctttatacaaatattgaaaatgatagtaagattaaggaacttgcccaggtcacaatttttttctttcaaatttcatggctgatttctaggcaaaaatttcaggggcctgtccaatacgcatgaattaccctactataaacaaagctagggaatttaatacataccgaaaggcattttgtaatatatcagaaactatacaaaaccaagaatagtcataaaataacattttaacatttttaaaaaaagattattccaaatgccctcacttccaggaatgcgactttaaaagcctaggctttatgttatgtcatcaaagtcattgtactcaattagacaatagtgctataattaattaaatgttattatgtaaatgcagaattaccaaagagaatttcaaagagtataacagtattaagtcgtttccttagtaatttctcattgctgtgaaaaacatctgtaacctaatacatttatattcatttttcatattatattatgcacatattatttttaaatatttgttaacaggtaattttctgattaccaaagtaatacttttgtattaaatgtttgaagactgcctccaaaaattgcaaagaagaaaattttaaaaccgttataatcctacctttgaaataattattcttcaaatgttagatatttggaatgtttccaggtgtttactggtatagttaatgctgctgtgaacatctttattgcacataccttttaacctctgtggaactgattgcttctttcatgatttctcctatattttgtcaatcatttcctttttttctttttcttttttttttgagacaaaatctcactttatcacccaggctggagtgcagtggcatgatctcggctcactgcaacctctgcctcccgggttcaagcaattctcgtgcctcagccttccgagtacctaggattacaggtgtgcaccaccatgcccggctagtttttgaatttttagtagagacagtgtttcgccatgttggtcaggctggtctcaaactcctgacctcaggtgatccacccgcctcagcctcccaaagtgctgggattataagagtgtgccactgcacccggccaattgtaagaattattttcaaaggaatttatatcaagttacagtgccccagaatattctgttattttagctgtattgaatatcataattttcttaacatgttttgtctttagatggtataaaatactatctcaatattattttccatttgtttgtttaccctttatatttccatttgcttgaactctctgctggaatctttcaatatctacctgatgaatcaatgtttatctgttggtttgttttctttttttttaattaattaatttattattattatactttaagttttagggtacatgtgcacaatgttatacatgtattttatttctttttgtcacataaatttgactctttattttaagcaactatttctagtcttttgttttttgttttttaaatttttattgtaaagaagttttgttttggccaggcatggggtggctcacacctgtaatcctagaactttgggaggccgaggcagatggatcatttgagacgaggagttcaagatcagcctgaccaacatggtgaaatcccgtctgtactaaaaatatttaaaaattatctgggtgtggtggtacatgcctgtaatctcagttactcaggaggctgaggcaggagaatcacttgaaccagggaggtggaggtttcagtgagctgagatcgggccactgcactccagcctgggccatgaagcgagattctgtctcgaaaaaaaaaagttttgtttctgtgatagatattttgcttagcatgcttgctttttatatttagaaaaactaaatctattccatctaaaatatattttggtgaataacgcaagatatgtaatctcagtgttatttataaaatgtaccattctcactttcttattttgtaaagcttgtttaatttcagagtttgatatattgaagagtcctattccactgacttaaaaaattgaggcagaaggatccccctcaagtgtcacatcttagaatttgtttgatggtacttcaaggcagttggtgaataatttagaactcaaactttgggctgcagattgcctgaatacaattaatagaaaacaaaatatttcctcaaattacattctttgacattagtaatcattcctttatatacatctcaagtctaaactcccaatctgtttatatgcagagattcacagctttaagatttatgtttcataactgcaatatcactctatgatacattaatgggattctgtactcaactattccattggcattcaagtgaataatttttatacaaaacttcttcaggagacaggcccaactgaagtgtatcactttaaaacaaatatcctatgggcaatagataaatctgatatttttctgagtagaagaaacataaaacctcaatataggattaatagggttcaaggggttttataagcacagtgcttgtgaaagtatgtaattcctattaaggcttgcattcatgagcacatcatggtatatgctctctctgggaatatgtaaagccagtttaaaattcaattacagacattgcagtctagacctccgcaagcctttgcacgtgactggactcactcaggttaatctctgaaccagttgtagagagcttttttcatctctccctcacacatttccaaactcttttctttctgtgttttttaactgtgacttttctttacaaaaggaaaagagaattttttttaagtccatgacatatccaatgaaatcgaaatgatttaatacatggagttatcttaatatcttttgcttcttgacagttctctcatatctatctagaaaatatctggccaaaaaaacccactttactttgtttatgagatattagattattttgtacattttcacattccagggctacaaggagaccacagtagacaaaatcaaaccgtcttccttttctttataggcttgtctcagcaatgcagcactgtaatgtctcttacttgaaggaacttcattctattgtaaattcttaggacaaatagaataaggagatagaagagttgtgtgagttataacttatatgtaattttctgtatatatttggaaagttcaacatcagatattgagtctatttcagtctgttgctgtgaatagaatacactattttatcctattggttcttttcttaaactgtcaaccatggtttgagcatagtttaagaaaaaaaaaatgaatgctttaaataaaaccagtacctgggttggaggtggcaaatatatacaaacctgtgtatgtgtgtttgggtgtgcgtgtaatctgaggattatagccctgtatctgtttcagggagaattttttttacatcagaccatgaaattgaaaggtgattctgataatctatttcattaaatagaagtttatgataccatagactctggaataaaaaattccttaaaattccctatttagattaatgcagatttaatccttaacccattggttcaaaactcaagtttactctttcagtaataacaagaagtggttgtcaataatactctcattaaaaataattatttcagcatttaaaaagtaataaaattggtattttctaacttatatgcttaatactcatccacaaaggttaaataattaagaaattaaagactgtgaagaagaagggaagaaagaggaaggaaaagatggtaatatggatgctattaccattcacaaaaacaacattgatgattaggcatatgttgacatttcaattttttgaatcttggtaaaatagtcattttaataacatacttaccagattacttaaagtaacatttcaactctgtttcagcacagcagataacattctaatccatgtaatcataagtagaaaaagcagaaagaaatagaatcctaacactttccaagcttccttctcttttgttagattataattcatgtacatccttattggggtatgggagacactggaacttattatactacatctcatccatttgttctgtctccatgactgacttctcaaaataatctaaactcttcagtgagccctttaaagtcatggttttatcctatatctgtccaggattttatctcacgttttgcatgtatcccagctcaaaaggattacttttctgaactttcattgcccttggattttgaccttccatatacttgaaattctctctttttaatatcaccaccaataaaaatccatccctcaagacctcacccaattattatttcaaactctaaatgctgatcaactatgtggagctgaccttttcatcctgtaaataagtgttattttctccttaagggatttgccacatgaaaactttgcaaacaaggacagtgtcttattcattttgaattctccattgtgcaatttctagctcactgtcatacagaacattactatcatatttagaggctgaataaatcattaaatggataccatcactgggcccatggaattgacttacttaactcaaatccatgtgaaagtcacttaataaatattaaataccatcaattctcaattattcatggggttattattcacaacttacttgtgatatgtccttaaaggtcatatttacataatgaatgattctgcctatttcattggcataaataggttcatttaaacagatttcattatttaattagctccaatttttcctttaccatctttttcagaaggcaagattttgcttttagctgtcttgcctaaatctgaaagctcatactgatcatttccatttaataagggaagatgaaaagggccggtcaggggactgggatccaaaaggtcaagagttttccattccttcttccatcagatcttcatagtggagttttgttaatttgtgaatttagttcaatgagccaaaaaaaaacttgctgatcaaaacaaagcccctttggtagggaggaaattctgtctctttgttttctcttcctttctctctgtgcgtgagtgagtgtgtgtgtgtgtgtgtgtgtgtgtgtgtgtgaatgtctcctgacatttgaaattcacagtgcaatttaacaataaaataataaaatatagctttttacaaaaggtgtaagcatagattaatgtacaggttttcagagaaggacaggttagcttgcttcatttttaatccttaggtaaaacagaggaagaggaaagtgaattttattgaaattcacactatgtacaatgaattacaagagaactataggaaatggttagatatgattaaataataattattttgaaattaagataaatgtcaaatgggaattatttgctttttcattaggaactgcaatgatgtttgcgcagcagtgatctatctagacagattttggaagatgtcagcaattttgtttagtctgtcagcatttgcagtggcaatgattgggatttacttgatgcattcactctggaaaaaaccttttgtgcacattagcatgacaactggtgtccatgaaatacaagaacaacattcagttataatgcactttacaccaaattaatgaatagtttaggaagggaagcaagagctgacttagatgacttacaaatatctgcttttttgcattttctaaggtagataatttgtgtatatttactttaaaaagtattttgtaagcaaagaaatgactgaaggaaacattaactccaacaaaacctaaattaatgtgtgtcaatgtaataaacttaggaagaaggcggttgcttgaaatattgtagtctggcaccagctccttcaaaatggccatgttttaaaagtatggcaggtgtgctaaaaagtctttattgcaaaatcattagaaagtctttttttgtcagtttaaaatgcattcagctataagcaatagaaaactaacaatggttgaatcatctaagggtttgttggtcttgtggaaaaggatatcaggaggtagcaaactagggctagtacagtgattctatgataccctcaaatatgtgatttccttttattctttcttctgtgccagccatcctcagcatatgggcctgtcctgtgcttgtcatctcacgaccattggcgatactgctcccacggcactatctcctcattccagggtaaagaagagaaatggaaaggaagtaggaagggatggtgtctgtatcagggaaacaaggatttcttaggaatcctcagcttatataaacccagctaccttgcccctctctgacaacctgttctttggcaagaacaatttcatatacttgcccctaccttccagggaagctgaggagcttgttttttttaactagacatattattgggtgattaacattaggcttatataaataagaatgaaagggagaatggatatcgtatatacaatcagcagtgtcagccacagtcttatagttaagtggacaccactaaatttggtgggattagaaaagcaattagttggtgagatataaaaagcaatataacataagggttttcaaacaaaatatcagatgatattacctgtatactattatgttaggggtataataccataaatatgctaaattcagattaataaaaagtttttcactttctgcacaatcatgacctccttttattaaaatagacaaatagtctggggttagtcacacaaagtctatatggcacatgactacaataattgatctgcaacctctctgttctttaaagtgattctgtgatatcaaggagtgttgaaattaaaccctggaagccacagaagatgccaaatggacacattttgtgactatttatagctgatccaaaaatgaaaggggagaatgaggaaactgattgatagtccccaattctgttttgatctgaaatagcttgttaaatgaatctcattgtcagagctagtttaaataataaatgtctctactctccactattccgtgcatatgtgagtctgaaagtaaaagtttgtaattaaagtgactgcattttaaagtttaaaaattgatctcaactaatagctaatactaataaaataaataactgcattctaattttttaattaccctggtttggaagcagaaacatgttttgtacatagctgtaatgttatttcactttaacctggttgtccccagtttagtatctacgaagctttgcacgtatcggaactccatacctgcttctcccttggtttctcttctcagtgataaaggatttgacttctttcttccccattccagcttgcacattcctgaagttttccggcttggaacaaattatattactaggtctgcagtatcatttagattgagaagtattgtgatagagcaaggttcaccctaagtattgactcttagaatctgctcattccatagtctgttgagtgcctttacctgtcactgttgtcctaagcaccaggagtgtagcgatgaaggatttctagtcctagttatctaaggactcacaattaggtttctattctggggctattttgtacatttgtgtacaaaagactgcatttttaaggtgtctgacttttgacttggtttcagaaggcataagaagttggtttcatggttacaaccccatgcccagaaaagttaagagtggtatttttaattaatttgtaactagaattaaatatagctagaattatataggaatacaacaaaagattaagatgtatatacatccctctgaataatataaatattgacaggctgatattgggttttctagacttactttcgtaggtattttcttagtatgaagatagttaaaatatactaagtgaaaaaaaaatactcaagtcactgtattagtggttccactagtaaaactacagacctcatctgtttctggaatttgcaattttaaatattgatttttggaatgtggcgacttacactgcctacttttagtttgccaggtgagctcatttttgaaaatatcctatactctgcatttatcctttgataaaatcatggctattataaattttaaaaatggtaaagatcatgtcagaataatgaatcgtgcttctaatttgataaatgtagcttaatcacaaatatacgaaactttctgttggtctggtgcaaactttctcaaggagaagatttagtgtttcagaaccattggagtagatgctatattaaacattgaggctctctcacctttaactttataaagctaaatatagtcaacaaatgaattggaaagacatattagtaaaatctaccgagtctaggcaggcctatgtgtcaggccaagatgcttcctggaattattctgttcagaatgattcctctttctttctcattctctaaagataggatgtcaacagtttcttcataaatgtaaggttataaaccatgacatttgtgaaactattgcaataatcttgggttgtgtagggataggatgacattttcagaggaaattctctaaacactttcacattaataacatctgggagccataatattataagcataagaagtggatctcatataaaaacataaaatatttttttcacatttatatgaaataacatatgtacttgtaacaactgagagtccctgatcaaattaggaaatctacagccatttattttaaatcttgctctaccaaaattggattgagagacaaattaaacacaaatcattagttacattttataactatagaggatgtgcagaaaacaaatattcaaacccaattttatgtactatattgtgccatatagtcacaggaaatctgttttccttctaaattattaataatttaaaatcatgaataattgtttatgtaagacagctggccaggctattaagggagtacagctacacagtaacaccaagagtgaggtgtccatctgagctaccacatggagaaagagcagctggctttgccccaccatattcagttgaaagctgcttattactgagcatttgaataacttgaaaggagagaaaaggaaagaacaacgtcagggtagaatgtttacttgtttgagcctcccaggagaaatgccatacaaagatttgacttgatttttaaatcaaaccaaagatctttcagattacattggagggctgaattgaaagttaacattgtataagttgtattatttttatgttcttttgtattatactatgttcccttttatattatgttcatattaccatgaactttagagtcgggatagatcagagctcaagtcttaatgtcatctcttccaaactgtgtgacctgggaaagacatttaacgtgtctaagcctcaatttcctcatctatcaaatggggataatatgtttactgactacaaattaagtaaaataagacctacaaaactgggtgctactgtatgataacacaacagttactacagatgctattattattaggtcacgtgtgtgaagagaaagtaaaaagaagacaagatgcaaagataaagaaggcaaaatgcaaagatcctatttcaatgaagccaatagtagtctttcaagttgctgttccttcttatttctcttccttccaataataataattcctattgtctaccaagtattgagagcctgtcataggtcagacacatggcatgcattgagagaaagagaattcaaattattctcttgaacttttgagcaactctatcaatgggtcttatttggttccatgttactgctgagtaaaagaacatgctcacagagggtaagaaacctgcccaccagcaccttaccagtagacattagagtcaggactttaaacaggcttttggactccagaaaccatgctctgcctactcaaatttagtagctgttctgaggatctcattctcacttatttccccttttttatttgtttgtttatgttctaaccactgatttgaaacaaattctcagaccagaaatttttactcctgtggaaagagtaattggatgttctcattacaatatttttttcttcatgaatgtaatcaaacatcagctggaagcttgcttttaatgcgtggataaaccagcccacacattttattttccctgaggcgtattgctgggaaaatctatttctgattttaagaaatcaacatatgctgaaccaactgtctattttcatttaaattgacaggagctgagactcaaaaattatgttgtattttccacttctaacattgttgatagaaaagttgaggtaaacactttattctgccttagatgcctgctaaattagtctctctaagtaaaaatgtcaggaggctattgttggattaatttaggtggagttgatacagttttagggaagaaccgttctacagtatgagaacaacttttaatattatgttagttataatctggagcatttatcataccttattatatatcgtatgttttgactttctcctctattgggctgtgggctcaattaagataagaatgtatctcccttatctttgtatatcggtgcttagtgcattgcctggcacatagcaggcgctcaactctgttgaattaaatgatcaatgagttaaactagatggctatatagttgatcttctatatagttgatcttctatattcaaaatatagtttacatatatgtatgcaagtgtatatgtgtgtttatgaataagaagaactatatcttcatactgttgaaaagttatattgtttctcatacagattttattcctttagctaaagttgtatcaatattaaatttataactaaaacgatattacgttggcacatgagggttttagtcagctccagctgctacaacaaaatactataatctggataacttacacaacaacagattaattttctcacaattctggaggctgaaagttctgaaattagggtgccagcatgtttaggttctattgggggccctcttcctggcttgcagtcagtgccttctgacatggtggagaaagagcaagctctctggtgtcttttcttataagagcaccaatcccatcattgcaggccccaccctcatgatctcatcacctcccaaaagacccatctccgaatactattacataaagggttagggcttccacaagtgaattttgaaggggacataattcagtgcatagcaatgagtatcttgtaggcttatgaccatataatttgaagctatgatttatgtagaagttggacaaaaatgtttcacataattagttatgttcacatgatctaatgcctgaaactcatttttaaatatgcctgaaactcatttgttaaaattatagtgttgggaaaagaagcatttaatatttgttagcattgaacttaaaaaaaattaaacacattgactttagagaaatgtatatgttgaagagtaggtgtggatgaaatgaaagaagagagctaacccttctcagtgccagacacagtggtgtgggcattaataattcaaccctcatagcagtccttagggtggtcttaaccatttcatggggaaattgagactcagaagtttactaatttggccaaagtcacataattgtttagagactgattcaaatcaatgtcttctttattccaatcaatcttttagggaccttatctgttatttatatgaaaaaaaacaactaactttaatgtttatggagtttgtttaattaaataaagcccttaggatttcaaattgtttcctaagtccaagagatcccaatgagaaggaacacaaagtaatttttaatgatttaaagtaaatgctttagactgaaatggtagcttctttttaaataacatttcaaattaggtttactattaacatttacaaagaaccagggctataaatcaactttatatgcagtgcattccattgatcttaatagttgtatttgcaagctgagtagaagagatttacagttctctctcaagggatagatctccttttttgggcaatgaatatactccttcagaaagtcctcttgctcttttacgtactcttttttgcttggtatttcaaaggctttttgttatactttaaaaatattcaacaaaaagtcactgaatatctacaatgtgtttatatcttgggtgtaatgcctaggttaataagatgcatagaaatatggacccagtgctacaggcccagcagtgagcaaaactcagggaaacaagtgacactaaacagtgtggagaatgcaaaggctaaaggctatatgagtcctggcatgagcacggaggtatgggctgagcagcgctgcctgaggaggtgatgtacaagtgggtatttatcccccccgggcaaaccagaaggaaaggtaaagccaaggaacaaagtagacaatggagatggtggggaatggagggagaagaggaaagaatcttggagagatagtcagtcttaaggtccaattaaactatttcatggcagccattattatcctgaattttatggatgaagaagtgaggttcaaaaatattacataacttgccctgtgtgacaaaataaatgaaaagcagagccaggttcaatgaaagtatgtttgacttaggttttaaaattctagtcataaatggcaatttaatgttgttatatatttgtattgggcttcagcaaaaacaaaaataaaacctcaagtacacaaaagctctagtaatagagccatgtttgtgcagttatttccagcaatccttggaacctccaaaattctcctcagcctgacattatatgccctatgtgtcatttcattatgtcaccacctggtggtgcactcacacccactttgggagaaagggggttagagaagggaggacatctgtggacaagccaataaaagcatttactggcatcgtgacttcataatttacacttttatttatgcataattaagtataaataaacaaaaacatgtattttctaactgctacctgttctgtttccagtcttgcttgaaaatcatctttctcaaaaaactacctatcatgtgctatgcccattacctgggtgacaaaatgatctgtacacccctacaaaatgcaacttagtcatgtaataaagctgcttatgttccctctaaacctaaaataaaggttggaaaggaaaaaataaataagataaaaattatctttctctatcagagtaatttgacatcttgaggaagtgatcctgggacttcatattctttaggattcaggtgtccagataatcccagaagtagccagcaatttggccatttggggtgtagaaaccttcatacctaggttattgtaatacctcaggctattctctccaggtttccagtgattaattagctgtgaacctcaaccaacacctgactctagaagagtcttcaaataggtcctagaaggaccaagtaaaatcaccatccctcaatccctcaatttttcctttttccaagtcaagaataaaagaagtctgggaaacattgccaggtcagcttctttttaagctcatgattttctgctacctgagggaaggagagaaggaaaaagaaaagaaaagaaaacctcaatgaatgctccataacctggattttaatctctctttccctttttgggataaaattgtttaatgtaattaactacaaggagaaaagttaaccagtggcttctgcttttgctgaaagcactttttcaaacccagctgtcatgtcaaatgcattcaatattagtttggacaactccttacgtgggtctcagaatgcatctctaaagaaagtgtttaaatattttttaatgtgaaaacccatatgggtattttggtgataggatttcttctatgattcaggaataaagtataatgcccaaataggcccttgccattcctatcagggacattgcatccataatccattttccatatccgtttgtatgtaaatgaaaagtctcacacatcacaacttctgtttttctcattgtaggatcgcctcatctgtatttatccacattagtaaaaattatccaaatcccagaaatataacaatagtccgtatttcttgagcatttactctgttctaggctctgtgttaaatgctttgcatgtaatgtctcatttagttttaccacattctatgaggtatttactctccttttcttatatgggtaagaaaacatgttgagttattcaggtaatttgcctatattcacatactggtcatgagaaaactagaggacccaggagattgaagcccatatttcatcatttgactgtcctaggaaacgccttgtatacttgtttttttaaggtattctgtcacccaagaacattgaaggtatatgcagattctcttttcctgttctattccactagacctgaatatgagggatgaaaattgctttggttttgatgtgacttcagtaccttctgtatttgacacagaggtgagtcacatcctgatcagtgttgaaagcatttagtaagattattagtttataaagaaggctgaaccatgactatataataatgaagcaattgtaaaaaaatcagaaagcattcacattcattccttgaatttccaaaagcattcaacaacagaaaaagggcaaacacgtttattccatgtatatatactgaattcctactatgcaccttcaacaataaaggcttttggtatataggagtatactgagcccagttagattcaagtgaaattcctagtaatgtcctggtatacaaggagcttaaatgttcaacatataacattgtttcttatgataggtttcacctataagccctctaaactgtttgtaactctataagaaataattaataaaccccaacaaggtctatttaatgtcttgagacagatcattctactcactttagatttcttatagataataaccagcacctaaaacaatttttaaagacataggaaatccagaataaatataactatcataggaacatggaaagaattaaagaaatggcagaagttgggaaaaaaactactggaggaaaagggtgaaaatgtgtgacaatgaagatttgcaaaggttctagaatactttaaattaagttagaataaacttttagttgcactgtgctttgactttttattcagcctaaattgtccttttaaattcaggttgttcatctccaaggatgaatgtaatttaactgaatcttgtattagagacttgcacatttctcactcattaatatgatcaaaagcatcttatttatgtcaaaagacgagaaacgaaggccatttttggcattgtcctaaagttgtgctttcttgccttattagcatttcatttcaagcaatagattgaacagaaatgcttgtgattgaatgaagattaattatagggtatgggaatattcaaacctttttaattgttctgagtagtgtcttctgctgttttgttatccaaaagggagtaagtatttggggaacaaagattgtgacacatctggtaatattcaagatgcacaccccctcactagactgtcaaaaggctgggcttgtcacagatgtcgaggctgtgatgtattgtcactcttgctgcacccatggatgcgcctctcctgatatgcgactcccattgggaatgtgaagacacagaggagatttttaatcaagagcataggtaggagtcaatgatgcatagctggcagatgcagatttcagcctgggaatatttagaataatttggattgctttatagtttatagtagcatcttttatgcaggactctgacctaattatttcaaaaattattgctactgattataatctcattgttgctttcttttatctattcattgtttaaacagcatttttagggggcagggtagggagaagcagtgtagcttggtaataaagggcatatgatctggacccagcctaccttggaaaatgattaagccccaattttcctatatgtaaaatggagacaatactagcatctacctcacaatattgttgattgaatgaaatgagataatataagtaaattacttccagtagtccctagcacataagcactcattaaatgttagcttttaaaattgtattccagattaacatgcctaaaaactagggctacgtactgagaattcatagaaccaattttactttgtgtctgtgttcttatgcctgcatcaggcattacgaagaatacagagagacaaactttctattcctcagggttgacaatagaagagaaataataatacacaggaaataagtaaaagtataattcaaactccaagtttaatgatgtataaaatgaagaggtcagtttgggctataacaatcagataagattcactaggtgctaaactcgatctaaactgagaaaaatagacaagacttataaatattagtttaaaacataaatctgaaagtgttactcccctatattttagtaagacttctctgtggcccttgctcctataacagtttctttaaggttaaaactgctgggtttctgagctcttctccatcctactaaatgagaacctctaatacaagaggacagtgcttggaaatctacatttgtatagaacccaagtgattcttatcaagcaaataatggaaattctatcttagagaagtctaaacatactaaggcccttgtttagactctatgtaatttcattttcagccactctgggccttgacccctgagaaccagcaaaagagaactttcttcagcacttggcttagccctcccctcttttgtgaaggagtttcccttcactggtcagtgttccttgtctttaatgatggtcttgaacaccactatgttgttgtacttaaaacacagagttgtaactgtttacaggtttatatccattaaaccacttgatcttgtgtttcatgctctcttattctcaccttagcatttagttaccactcactaaatcagttgatcttgaaactttagaaatcttacccttacctgaggggtccttgtttacaaagcagatttctagatgctcttgctcaggtactcttattctgtagttgaaatgggcattttagggccagacactttggctcatacctataataccaacactttgggaagctaaggcaggaagatcacttgagtccaggagttcaagacaggcctgggcagcatagcaagaccctctctctacataattagcctggcatgatagcacatacctggctactcaggagactgaggtgggaggattgcttgaacccagcattttaaggctgcagcgggccacaatcatgccactgcactccagcctgggcaacagagcaagatcccatctcttaaaaaaagtgagcattttaacaagtgtgtaaatagtctaccattctcttaaaacacacacaaacatacacaccttgaaaatgcaaatgaatgaatgtgtgacagagtggaagaaacagcttcagaagggagaataaacatagcatttacagaagatagtgagaataccactgatttggtatgttggatgctggttgggagaattttatgggaaaaataccagttgagtgaaattatggatgttcttgagaaatagcagagtttgaattgaatgtggctttttgcataaagtggtaattttggaattttggaataggagaatgaataaagatggcatccccaatagttgtcatggctagtcttaggaagggttggatcagatgatctctaaaatatctcttaacactgaaatgtatagtgttatgctataaaatatgtagatattgagttgtattaataaagccttagcttgtattcatgggataaaacttctacttaaataatattgtaatttcattcattaatgcatgtgtataaaagtggatcagtattgtggaaggtttgcttaaggtgagatacatgcaatggtagcctggagccaggtagtagtaccagctcaggagtactaactgttacgtattcaatgattttgagacctggttggaaagcacaggcattattaaattatataaacccgtaattaaataaattatatgaaatgcaaaggtaatcaatactcaaaactcattagttcccaagtacttcattatattttactattatccatgctcttgaggttatgtagtccatcgtatctgtgtcgtggaaatactatataatgaggtgcagctacaaatctcttcccaactccacattcagggccatcacattggtagcttgaaataagacatgctgatagtagttacaccatggaaatggacatactgcacaaatcaggcctttttttttctcctggagagccaactgataaatatttaccagcataccaatggctcatgtttagaatagtcccattgttttggggtagaaattcattttggtacatggcctgactcaaaagttcacccctttagtgttacctcctgttcagcattgaagccacttatgtctccttatatgaaaccagaaacaagaggctttttttttttttaattctaagagtggctggctttagttgtaacagaagagagcaggtacctttattgtacttcaatttaaactcctttcaaaaggatctgagaactttttcaaaaaaaatttattcccccaaatctgataaatatgcctctattttacaatcttttacaacttttcaaattactacaatctgaaagacattttcaatctttcttgaaagacagggagaatattgccatggatgaagaaaacaatgacttgtttctttcattgtataaaatcattcttcatcactgtgaaaataagaaaatgaattttttttagttgagcacaatctcgagatctttctaacagcctctgttcttacagtatggatgttactcttggtttatagctctgcaaaggagtcaaagaatcttccttttatgagggccctgaagaaagaaaattgtgctgataaaattactttatgtgcgtttgaatgatgatatggccaagcattcttcagaaacttctgaatttttcatgtatgccttcaagagttgtaatccttacttaagcaaatgtctgtttaggagagattccagagattttcctatttagagtgttttaaaaattaaggaaggtgttcaccagcttactagaggttccttgtgaaaagagaaatgagttttcttcaacagtcttatgtctttggttcaagctgacataattaaggtgtaaacatatcagtatagtttgttttgattaaactttagatggacatagaataggtaatcaaattcattggatcgaaataagtattcttactctgaaatgaaacaaaatggaatcttcagaaacatggaaacaatgacccaaacatcagagaggcattgaagataaatgggaatatcactgggaatagtgtaattggagcagtgttttccaagcccaatcctcagacctctcgaaaatggagattgtaacactagattgtgggcagtctataccaaaccaacagtactgaatcagagtgggttatgggaatggctagagcatttgcaattttacagcatattcagaagatttttatgtacactgaagttgagacgtgctgatttagcaaaggtaactgacaatttgcctcaattccctcatctgcaaaatggggattataaaagtagggttgttggaggactgaatgagtacatatatgtatagtgtttaggacaatgtctgctgttttacagtaagtgctctattgttggctcttgccactattattgttttgtcaagggcttgtctgtgctagctggaatggaaacttaaatgtttctaattattgcaactgtcagatttcttaaatatcgtaatgaagccagcacagtgaagagctgtcctcagtttaatgtaacattggatctatcctaataatttttcttagtttcctattgcatttgtaactattttatttaaatgttttatttttccacagggttacatttattttattacttcagaaatattagatgtcattctgaaattgtggctgtgcctttatcttgcatgtggaattcaattttttatattctttacaaacagtatttataagaaataaagataaggttacagtgagttgttgtatgagatggtaatttacatggggtgctccatatgcttagcttttctctgaagttatgcatccccacagcaagggaaatatttgcatttctgagagtgagaatttatgttcatcctctactaggaatggtggcagcttttccaggtcaaggccctgcagatgcctgatggtcatggtaaatgaaggctggatgcagggaaggcagcaaaatgagaaaatctcctgggatcaattaatgggagtcatctgagagagaataaaggcaggagaacattttcttctagtcaggaattcgcatcagttttgcctggtaatgggtttcatgaaagccaagatgaaagggttttatccctaaggaaaaaagggctctcctcacatcctctttctgtgctcttttatcaatgactaataataacatgcttgcatccatgacaatctttcagaaaactgatgcaaaaacaagtccaaaattagagtgtacagctgtcgtgatttcctggagtttctggtgtgtgcttagtaggcacacagtttgagttacatggcttcattatatgattacacactactttgttgcctcattggtggttaaggtgattttaaacttttcagtacccaaaagcagtgtcctggaacataccaatgaagacggagaattgtttcagtcccagagatatcccaagcaaatacagcagtgaactcaatggatatttgtgaaatgaataaataaatgaatgaatgagtactactgtgaatattcttgtcatgtttgcttgttctcatttggagagtttctttgaggtccgtgaccagaggttgaattgctggatcttaaagtaagaggattaccaacttccctatacgatgctcaattcctctccacaatggctatactagtttactgtctggcaatcggtgtatgagggttacctgtttatcacattgttgtaacatttgattttgtcagatgtcaggttctaactgaggtccaaggggagttggtgggcaagtggcgggtagctggaaaaacacgtgaggaactgtagacagtttcaacatggatttactctctctctggccatgagccatgagcgcaagatgtatgtacagcgtcagcagcgtagttgtaccttttacagacaatagtggctccaagccaagcacaagcttacatgggtgatcacctaatgtgcctcacgtggcgtggttacataatgtgcagagttgtgagcctgtgctccaaactcactgagtcatgctggaccggatgtctgcttcggcctatttttgagagcagcacatccattttccttacactccaccctcaatgccaaaggagacacaggccttggacacacaggtctaagacacaggccttatacgtacactctggggacaaaggccctggacacacaggtctgacacataggccttaaattctactccctaggctgaaggagtcttttaaatggagaaacatgcccacagggtggaaccccagacccagaggccacagcagtaatacaaggagcaacaactccaggttatgacgggcaaacaccccatgatgatgttacccgaatttactttatgcattaagccaggtttttatttccctacctttaggggcattggggcatgcaacaacaggttaccatccgtttccatcctggtcataggaggtcatccttcctcccataggtcttgccacatggcctagccccacatgggccagtggccaactagccacttctgtattttccaggtgcctaaccacaaggttaagcctcgatagaccacacagctattggtgcagattatcatatgtgtcacctctttggtgatcaccattcatattgctctgacttcagcccattgactactttgtccatacccggtatgaaaccatatggagtcagtactaggctggactgtgagcagtccaggcagtagcagcaccccagctagacccatctgtgtaccgtgccccatcgggcatagggggggatgcccttccttaaatggtgaaggctcagcatgtaggggtgcttcaggccccatgtccttaggccccatggccttatcttgcattaggactgctggtctcaagacctcttgcaactctgctgctaagggacttgtactcagcgtactctgttgcttcaagtaggtgccccactttgctaaagtggatgtctgcactgtcccagtccggggggttgttatcaatgaacacatccatcctgctatcaggtaactcgtctacacgacaactgtagcctgtcctgccatgctctcatgagcccgaagggcagcatatgcagttactaactgcttctctatcagtgaatactggagctcagcttctttccatagttgggaccaaaagcctactggtgttctcaagcactccatgctctgccacaggccccagccaaaaccatctgtggtcacatgcacatccaactcaaatgagcacccttggtcaactacccatagggcttgtgcctgctgaatagcctatttagctgccaggaagtcagtctcagccacactatcttaattctaggcaagaggagcattgccgcttctaaatctgcaagagaatcagaggttaacataatattatcaataagaccatgacatatgatggggctatgcatatatccctgcagcaacactatgaaagtccactgtcaccttcccgtgaaggcgaactgttcctggctctctagagcaatgttaattgaaaatgcattaatcaagtccaccacatagtggcactgtccaaattccatcatcaagcggtccatcaaatctgtaatagatgggatggctgtcaggccatgtaaaacatccacccccagaatatatcagcgctggtgtttaccagtgccagcacttgctgtatgttggtggaggaccagtggattgctaatttcacatgtggcctctatttgtctggtgtccccccaggccaggcacctcagccagttccctaatcaaacagaaaaagctcaacatttccacctggctgcagcaagtagtctttgagttgaagcacctgagtgggaccaggtcatacagcaatgtcctccttccccttctgcatttcctggaattgctgctcttgagacagttatctccacaaagttaagagtacttcattgggctgcttatcgattttctctcagtcaaccctggccaaagtcaaatctatccacatctgtgagtgggtcacttgttggggcccccttttcttccatgatggggaggctctgcaggtggggcatcttccccttttttacagtgcagacccagaccaagcaggggtctctggctgagatgacggacccaggcctgcattcacaacagcctctaactccctttccaaccctatgccaggccttcaggcaccccacctgcacctggagatccccattcatggcagcctctaactctttttctaagctgtgtagctgggcctccaggcaccctgcctgtgcccaaaaggccctttcctgcactgcatccctcagggattgggagtgtacttcttgtagcacagaaaaaatgcccatccaactctgctgtcaaaggctcattccttctcggtgctctgcacttccagctgcttcagtgctttctccgtgctcgtggggtacccatctactgctggccaggtttccaacagagttcacccttgcagcacagctgtgaccaggtaccacaacccatgtcgtggccacattgccaacccagaatcagcagggaccaaaggctcgcccaccttgggatcctgttcgtgatgccaattgtcaggttctaactgaggtctgaggggagtcagtgggtgagtggtgggtagctggaaaaacactagaggaatcatgcacagtttcaacgtgcctttactgtctgagtgtgagccgtaggtgcaaaccataggtacagtgtcagtccggtagttataccttttacagacaatagtggctctgagccagttacaagctcatgtgggtgatcacctaatgcgccttacgtggtgtagttacataatgtgcagaattgtgcacctgcactccaaacttgctgagtcatgctggacctgatgtctgcctcagcctattgactgcagcgcatacattttccttaaatcagatttttaaaatttttgcctgtcagatgaggtatgtctgtcactattgttttaattattttttcctaattgctagcaaagttgcctatcttctcaaatgttcacttattgttttttttcctgtgagttcttgcatccagtttgaacagtactatttaactttgttttaatgctgtcaaattcctaaaatagttgcttatgtcacagaagttctaacctcagaatgatgatatccatgccaaagcagttgaaatttaaattcttagataagtaactttaaatattccagtgttatagtaaaacatttatactggactattcactcaaaaattctttaaacagttgtcaaccttatttatttcattataataattgtaactttaaatgtgagatatgataaccacatctctgaaatgtgacaaccttgtccaccaatgttattatgcctgaaacataaatcttgggcccctgctcagaacctttgccttctagtttcagtaattatgaaattaattttgtgtttggtgttttgcaaattaaacttaccctattaaccctatagcgtatatacattatagatatattattataattattatatttttaaaaatagctttatgctcattgggcagaatctgtatcagcacattttttggcagaatagattcagtagactaataactctgttataaatccctggtagcaatgttgggtaaattcagtggactaataaatctgttataaatccctggtaacaatggtggggttttaatgagtaacataaagaacttagaataaaacaacttaaatatatatatatatatatatatatatatatatatatgaataatattaacctttattcttatatttgtataatgtagttatctgatttgcagagggagagaaagagacagacaaatggatagacagacagaacgagatcatttagaccataaggttagaaaaatattatgagactatggaaaggtaatgaatatggtagagagagatggagctgaagattataattctttacttatggactgctctaggataactttgtttgatgttattttagccttctgatatcagtttatatactctaaaacgagtagaaaagaagcatcagtttgtataaatattctatttaaatattgtcaaagcaggtccatgcatcagaagtcaaattaaaactcactggggaaaactttgaaaaggcctgaaggaaatgtacttgatttttataatgtaattggcaaaggaaattgtagtcaaatatgagagctaatgaaagagtgaatggataagtaaaatccacaaataagcacaaatgtcattgggctgtttccctttccttaccaaagaaaatttcatgagagttgctaatgaataagatctgaacattatataacctttataagcattttcctcaaccatttttttctggttgagatgtcaacaagaagtaatatatcataatatacaaaagaagatgcatagtgtattaataatatgctaccaattaaaaatcgctggaataatttggcattggaaatgatgaaggcataaagagcagatcttgtattagacaaaaactaggaagttatagttaggttgtagtaaatgatgaacaatccattttgattgtgattcccaactagcttttaggcagagcctcaaccacagaaactcaatcctagtggataaaaaatatgcagacaatttgaagggagtgaagagagcagaagaaagtatgatgaaagaattgaaagattatgcaacagaggagtatttacagcctggctagataaatgaatggatatattattttttttaatttttttagctaatttacattgttaatttttatttaactattatttttaaaagaagataaatactgcagtggaaagagacttaagggattatactaagggcaattatgagaactcttgggacaaaataatggtcttatatcaacaaaaattccctggaagtgtgatatgtcagcttgcagaaaattttcccaatgtagtgataagaattctctgaagacataggcagattgaaaagacatgaataagaaacaatgtgagatacatttccatacttactgcagaggtaaagcagaatggaatttgtatcttttcctctgcaggtcctattagagaagacaatagagaaccctctaagaggtgattgtcaaattggttaatatgctgtggtttggagtgcctgcattgtgaacaagggcacattcattcaactttccacatcttcctttccctgtaaaatgtacatggagttatggtaccttattaggctattgttagtatcacatataaaaccatgtaaaattcctaccgtatgcctggttcagtcagtgctcctcaggtggtagctattggttaaccctattctttataacataattgaaattaggttatatgacttttaaatatccaaacagtcagaatagaaatattgatgagaaattttgcttcatctcaaaaacagtgttagaactacaccaatggagtatttttctcctaaaaggttaatcaggatatgacatttataggatttacaatcacaatcctgataactgtgaaatataatatcagactgtttcttactattttatttttaacattgacattaagttaaataatatattttgttactgtagcctaggattttattttccctgttatgagaacaaggataattattttacaaatgaaattttaagggattagagtgccatagacatgctcattgcattattaatgtgcagaatactggagttctgccatcttcatgaatccccacattacattttggataaagaataagttctgtatataaatgtaggcttcagaagcttttgttgattctttcaccatattttatacaaaggctttcttgctttcctgcctctcatgctaagtacaggcccttcctgtactttcggctaaacgagatggcctttcatgtataaaactcagctgaaaaattgacttcttcataaaaccattcctgtttcatccctgactcaaggtcctgacttgaattcttccgacttccctgggcactgagccagcatagttctggttcgttgtataattgtttatatccttgtagcatattcagatgcacatagtcaccatgtctcacccagaatcagaatctctcaaggaaagaaagcatgtcctctctttccctaataatccccaaagctctcaataccatgctgtgcccacagaagggaatcagttaaatctgctgcaattgattggaaacttcttttcccccagattttccttaggtggtctcctgcagagttctgtctaaagtaatggagacttgggatttgtattctcattatgctaatggttattacttcctttatttttgaaaactggttgtaggatctaagctaaccatgctattttctgcataccacccagcgattctcatttagcaactgccttcaaatcgtctactccctttggtctcctcctcccctcagtaggagaaggatgagaggaagttggaatatttacactgagatgagatccttgagcacttgagccctgaggctgcctctggactaacgtttctgttcagctgtccccaggtttttcaacaagagctgtcagaaacaagtttgtgactaaagagcagcttcatctgtaacttctgtttcttgctactccctgctgtgtttctggctatctggaagcttctcagcagggtagcaagttgttggcgccactaacacctttcctctttcaaattcatattcttccttgggaggtgagtttgcatttcagaaaattctattttagtgaaaccacccaggaatcagtgtcagttggctttcagctgtgaaataactgcagagactttgttacagctaagggggtgcgattcttttggagagtttagattttctgtttatagagaagagttcttaggaattttatgcttagctgaaagtattaaacacttttccttatttcctcaacatgaattctttttcccggggctgcaggggaaagggctctgatcctggttcagtctctagcttgatcattttagtcgagttcctttacttccatgcaactctgtttcctcaagtataaaactattagttgagtgggtagaagaagtagatgatctttaaagcactttttaagtctaaaatgttatgattctgctatcaaattcacagcttctcaacatcagataagggttggcatgagtgttgctgaaaatatatttgggttggaggaagggatatcctcgattaaaaaaaaaaaaaaagccagatgagaaattaagacttttcagccaatgctattgacataaactcagggtgactttcacgtcctaagtagaagtggaacgttcattaattaaagcttaggtaatacctctttatcaaaattaataatttatgttcaaattaatcatcatgaattgacatagctaatttgacccttcatggttatcagagtctttttggtgaatatcatagtctacattaattgaaagaggataaggtacataggtgtcctctcccacaactaagccatcatgtctaatgtagtaatgaaagcagattttggactgaattttgttgactggcaagcttttgttaccaaggagccacaactatcataaagcctattctcataagctccatagactcccagctttctgtcccttagacattgtgataagcgtcttacatggaagatcattttttattatgtctgtttgattcttctctctttcttccttattagtctagctagtagtctatctattaattttttcaaaaaatcagctcctgtattccttgatttttcaaagggcttttcatgtctatctccttcagttctgttctggatcttgtcttctactagctgtggggtttgtttgagaggacatgaacagacacttctcaaaagaagacattcatgcagccaacaaacatgaaaaaaaagctcaacatcactgatcatttgagaaatgcaaatcaaaaccacaatgagataccatctcacaccagtcagaatggccattattaaatagtcaagaaacaacagatgctggtgaggttgtggagaagtaggaacgcttttacactgctggtgggaatgtaaattagttcaaccattatggaagactgtatggcgattcctcaaagatctagaaccagaaataggatttgacccaacaatcacattactgagtatatactcaaaggaatataaatcattctgttacaaagatacatacacaggtatgttcattacagcactattcacaatagcaaggcatggaatcaacccaaatgcccatcaatgatagactggttgaagaaaatgtggtacatacacaccatgggataccatgcagccataaaaaggaatgagataatgtcctttgcagggacgtggatgaatgttctcacttataaatgggagctgaacaatgagatcacatggacacagggaggggaacaacacacactggggcctgtcagggagtggggtttagtgagggaaagtattaggaaaagtagctaatgcatgctggtcttaatacctaggtgatgggttgataggttcagcaaccactgtggcacacatctacctatgtaacaaacctgtgcatcccgtgcatgtaccccagaaccaaaaacaaaaaaaataaaaacctaaaaaaaatcttatttcaaaaacaggctatgggctagatgtggcctgagggccatagtttgttaaggcctgggactagaccaacatatgcatgtgaccatcttgtggatgagtttccacaagactgagagctccataaaggcagagactgtattttctcattttttattcccctcagtgccaagaaaaacagtaattcaataaatgtttgttgcattaaagaatttattcacgaagagttataaaaatcaatccactgtttttccatttgctatctctgaacatgtactatgtcatttttacttgaagatatttatattgaaatctctggttagtgatgtctcacttctgtgtacagctaagaagacgtacagtttttaaaataatgttactaactgtaacaaaaactattttatcaagaaatataaaagaaattctttaacaaggttgagaggttacttcatgcattaagtttctgctatcttgctgatgttctgctataaaaccttacagacactatgtctgtattactggtttcatttgaaattttgccttatgattaatctaatttggtttcattgtccataataaaaagcaattgagcatcactgatgtggataccattttctttaggttttaagaaaaccactctaatattttttcagggccattattttatcaaatatgtatatatgtgtgcataaggagaaggagctcggaaaaggatttatatttccttatagtcaattttatgttctttctaccctaccactagctccaccatattgaaaatatctctataaatatgggttatgtcctataagcaaaggatacattctagaattcatttctctctaaaccatgaagcatcatccttaagcaagatgctaaacctgaaacctctgtagagcacatttgggtagacttatgttctcattcttgcctagaagagagatatttctagttttcttatttgctaaccttataatttgagcacagaatgtcagatttgtttcagcccttcgatttaatcacatcatgtctgatatcctagcatttaattacccaaattcccagtgttgttcaagaaggtaggtctgtggtgggttagccttaagctagtggctgaaaaggtcttgatttgcccccacatctaacctagtcacttcctgagctgaaactcccatatcacctggggacaagcgaccctgaaatcctcactggccacagcttcttctgagggaagctgcaggaaaaagaacaaaaatgagcttttgtgaaaggattaacttgggtgaagaacatcctccataaccaaataaatggaacctagtaacccacatggccaatccccagggcactagtgtctttggggatatcagggtgtgtatagaatttcgtttttgtcattcttgaaaacataaaaaaatctctgaaagagtactagtggtcaaggtactagtctagagatggaccaaacaatcatattaaacctaatttaatctccagaatttatattttgagattggtagcactactatcttcattttgtactttccccaacttcctgcagctaggattcaaatacagaccatctaactccagagcactgccctttaacattgtgctataatccaccactttgcatagttgatcctacaagaggataagtagagatcaaagtaagaagtgatcaatggattactatgtcaagcatgattccctcaaactattgggaagaataaataccataacatgtatagggtgctgtgtacaattcctggcacaaagttaagtacatgataaaatggaactattaatattagtaacccagataggttctgggcacattagcaggaaaggtcttcttaatttaagtaaggtgctaaaagcatctaattttattaggattgttatgaaacaaaaactaaatgtgcaagaaaatatatttaccgtagcctggggaaaattgtcatggtttctcttttcaaagaattcaatttggtaagaaacagccttcaatggtccatgaaaagtgagaagtgtagggaataagaggctctttcctatgtttgcatttcaggcttgccttcttacttttaaatttatctttacaattgccttcctgctgggtttgtgtcttcctcagtttagggaaggtgacaagaaaagtcctgtttgtgtgtaattgacatgaaaaatggtaggcttttaactcaaggaggctccagacaacagtttggttattaaggaaggggaggacctaggggaacaattgtttctggcctctcttcttctcaggcctggaacaatctttcatttactatattcttgccacaagagcacagtcaatattaaattccaaaaaaagaaaaatccctcacagaaacagctgtgttcaatatacagccagtttactctggcgaattgctagacatggaacagttttcatttctttttgtgtttatccctgatagttgtcttgtaaaatctgccttttgtaaataagggaaggctggttttaaacagctttgactaatattggtagttggagtattcagtattacagagttttagagaactaaaataaacctgatggaaacacacacatatttcaaaggaaacattttaaggtgttctggttccattttttccattttgtatgtaagttggattatgatacttttatgtctacattgtctcttagtcaaaaatgtgagagacgccattcaagtctagacttggaccctactgaatgccttgttcatggacaccacacaatctcgatgtaaatgtttattgctgatctgtacaaaaaggggaaaagtagttttttgaacaacagaaaataccagttaatctcactggattcaggaattatagcaaagcaatccaataagtggattctctgagagtaggaactcaagtgtgttatctcagtttttatccagtttccagcacaatgctggcaccatttaaattctcagtcaatgctggagaattgaaaaagaatcctcaaaatttggatgacaaaatgacaaaggtgtcccctgatacagaaatctgtccatggcagaaagattagtgatttgagatatggtgtcatcattgtagatgatggtgtcccattaagcatgttttcactaattacaataaatgttgaaagaaggagtttcacctagtatccttactaatatcagggaatggcctgggctttggggagatgagagtcctctgctttcagtttaataaagtaggatatttgtgtttttgtttatattgttaaatacgacgggttagcttgtcacctacataatattgtgtggcataaataaaggtgaattcccaaatatgtgctccatagtgttgacaatgagtaaatgttcattctaataattgtaagggttacctccctcgcactccttgaaatatctttttattcaaatttttcgagctggaggtcatgtgttacatttcctgttgtgtaacatggcctccctctctttctctgtctcactttctcactttctccctctttcttttactctctctgcctctacctctgactccttctccttcttcccagctttgcatcagagccatgtaactgacattttcttggttccctcaggacctgtcataatagcaggcaaatattagatgatgattcaatgtttaatgaatttttcttgaatgtatgtatgttgcttcaagtcattcatgcacacattgaagaggacagacagagccctgctgaacaccactagcaaatctctctctagtagaccacaacaagtcaatctgtgctctttgattacagttgttcaaccagttactaatctaactaattgtaactggttgaacaactgaacccaaagggtgcaaagtagaaacatttcattgtgaagtcggctggggacaaagaaaacaccaccagaacccccttcaatatgcaaagggaaaattccttctcaagtacaagctacatggtgcctttttgaattatcatcaatttgtaatgctgtatcaatacatatgtattatctgttcttttggtaagggttgtttgaagtataaggtacttcctccattaaggtgatactaaccacatgttaattattgtctgaaagtcaccaaggatatgaataataaaaagttttaaaaataagacctgtttcttttattgatagttgtacctcaaggctgaagtgaggtttgcaatgtaagttgtaaaatgtgatgtgaaatagacaattctttgtagtttatataaggcaatatatccatgtgcaattatggtcaaaaacagcagacttttaagtgattattctaaagttatttttttccaaaataactttattactcttgatatcataccatattcacaaaacattctggtaaagctattgctcagtgtgttgtcccagtgagactcagggaacatttctatgtgacgctttaggattgaagacagttccacgttttctgagtaattccaaactgtgtaagagattatgttccctttgcatattggctgctaagaagctcactttttcacttatgatacttggatgcattttggctttttgggtttttgttttttggtctaatttttttttttttttttttttttgagacagggtctcactctgttgcccaggctggagtgcagtggcaccatcatggctcactgcaaccttgacctctcctggctcaggtgatcctcccacctcagcctctcaagtagctggaattacaggcatgtgccacaacacccagctaatttttgtattttttgtagagatgaggtttcgccatgttgcccaggctggtcacaaattcctggactcaagccatcttcctgccttggcctcccaaagtgcgggcattacaggtattagaggtaggagctactgcatctggccatgggaaacattttgaatgataactttgtttgtttgttgtctgttgagcaggctggagtgcagttgcatgatcacggctcactgaactctttcctttaatttttttattctctcagcacgattataatttattttaaaagtagggaataattggccaggcgcagtggctcacacctgtaatcccagcactttgggaggccgaggcaggcagatcacaaggtcaggagatcgagaccatcctggctaatatggtgtgaaaccccgtctctactaaaaaatacaaaaaattagccgggtgtggtggtgggcacctgtagtcccagctgcttgagaggctgaggcaggagaatgacgtgaacctgggagggggagcttgcagtgagcccagattgtgccattgcactccagcctgggcgacagagtgagacttcatctcaaaaaaagaaaagcagggaataattagtaagtgcctaactaatcaaaaattgtttccaggtgatgttgctgttgatgtatgaaaacctctttcacctagcttccctcttcattcttttctgtcatatttctattgaccagtgctttcttggcccttggaaatgtgattaacttttgccatgacctctatgttagtgccacacctgacacctttatgccactctctgcctccagaactctgtgtccatcttatatgtttttaccttctgctgggcctcaggtctggatgcaaagctgtagaggaattgagctgtttttcacaagggatccaagaacacatagcatgtgtgaactgtactaaagctttgagaagttgtgaagaagattcacatcaactatgcaccacacagccttcttgtcttgctggtaccatctcctcacctctgtgttgctcctcttggagtcttcaccttccacaaccagcacttctattctcactgtctgagtgtgactttccataattgtgaaactccttgggcttatccctcacactcattcttgaattctaaggaatggcattttctccattgtgcttacatttgcttttcagtattaattgttctagagaaaagcattcattcactcactcactcattcactcatttaacaaaacctgtatgggtatctacagtactatgttctaggtatactgaagacactaacataaataatacaaataataaccttttctcagggaatttagattaaagtagttcaaattggagcaggggaagcaaatatttacgtagattatcagggaaaatgtgtagtgagtgccgtgattagcactatgcagaagattttatgggagtggcaaaaagcagaacctaaccttttctggggtgaaaagtgtgacctaaactgagtcttaaagaatgaatgtagggtggagagaggaataggaagagcatttcagggagagaggaatagcaggaacagagacactgatgcaaggaatcccatggtatttgtgatgaagggatgatttagtagttcagtgacaagacatgagcctggagataaataaggtttaggttctggggaccttgtgagccaggttaaggactttgggttcatcctcaaaccatgaagcattccaagcaattatgtgacaagatcagattctaggggctgaatggagaataaatatgtaagtggcaagattgaaggctgggaatgtaaaaggtggctcctgctgtggcttgggcaaaacatcacataggcttgagctagctttgtgattctacgggattgagaggagaatgctaatttcataaatgtttagtggatatgattggcatgtgatctgaatgcaactggagaaggggaccagtcatttactgagttgatattggtaattgataaataagaccaaagaaggtgaggtttggggataggcagtgtaaattttggaagtaataaggggattgaggttctgtccatggcattggtggggaaatctagcatgtaaatacatgtaaatagataagtaaatatgcctatacatttatataagatatctatacacttattctccttctttgttcatttattaggtgtgaaatctacgtgatttttttctcccatattatttttggtattcaataaatgtgaatcatgaagagatagctgttttatttaatctctgcaaagtcacattcttacccattttgattgtaataaaaggcctatgtcgttatttaattttttaacctttgtggcatgatttatagaaggaaaataaaagtgtcataggtatgataggccaaagttgggttgttggtaaaataataataccacaaaatgtttttctatttagccaactactgcaaagttactttaattgtgtttgcaattaattgatttcactttaaaccagaaacaatagagactgtaatcacacagccctgcagttctgaatgttttgttcttccttttattggttttctagatattcctagttggcaacaggatagagttcagtaatggttatgcaatttcattgtgcagggtattaaaatttgtgaccagggatcccaggagaccagctattagattttcaatgcactattagattaaatatatctactcaaactaaagggatcctgcctgaggctgtctgatcaatagtctatcattcctgtgcaaatgaagctattaagattctcttaggaggtagactatctaaattggatctaactagtagatggtgactgaaatgagggatatactgatacttaattggcatcaatctgaccttgataagattttgaaaaaataaatacctttttgctacaggttgaaaaagaggtgtaaaatagtccctattttatattattggttcttaagtacttatcagaaaaatgacaaaagtcagtgtccataaacaaaggttccattgatctttgatcaccaaatcatcatttctatcttcctcttttttgtttaggtcactgcagtcaccattacctccaccaccatcataattatatatagctaccacttcttggacactcaggtctgcttgtgtttgaaccagacatttctagctccaaagcctgcattcttaatttcctgcagtcttaataccatctttttaatagaagacccccacaggaaaagctgattctataatttaaaaatgatttggggatccaataagtcatgattctattttatataattttggaagatgtggccagagagctaactctttttattttattatttttcttttaattgttgacgtacttataaccaccagctatgaagctataatttattgccacattgagtatgttaaattgttaatttacataatttctgattcttatttctcccctctcaaattcaatttgataatttaacatacctgcttctgtgtgttccatggaactattaatataattttttaacagaattatgagagaattacatttccccagctgtagatcaattgagaaacagtagaaatgaaaaggttaagaaattctgcttcaaaatctcaaatggtcaaagtcattgacattgtaagctcttctgttcgactcaagcctggtggaaaatgtaatgaagaggtacaaagtacactgcataatccagcaagctaattgcccactttaaggcctcttgagcccaatggccaagtgaaacctccactctcagggaaattaggcaactgctaaggtggttttgcagttttcagagacacagagattaggtttttcagccttatatagatctgtgatcactaatgatagtctgtgctaatgaaggtagttttttgaatcaaatgcatattgacttaggtcttcagcgcagaatgttgattcactgctgtcatccctgtcaagagagctgcatatgtaattatggttttcttttgaatagatttgctttgggactgtcacgcaaattccatttcttcatgttcttgctatctttcaacctcaaataaataaataaatagaaaaaatatctctaagcactatgtgtgggctgtcattctttttacatttagtgttctaatgtttttaaacaagtcagtttacaggtaaagtttgctgtaataggattgaatgtgggtgtatgtggtggtgcttcagatctctttccttctgcttgacccttcatgttgggtaatagttttaaagcgctcatgccagaaagtaaaccacaacatagtcaacttctcaaatatccatgcaatgtagaaagtccggggtcaagatgattactatgtgatctgcttaagtgggaacagggccatttccctcgccttcaacacactcagatacatctcagccaaccaacattttgctgtttgaaaaacatggcagactttatcttgtccctaaagagaatgcttttctccatccctctgcttaatatcctgtggctccatttaacctccaagccaaagtccagtttcttttagaagacttcaggcaaaattaggagcctcttatagtgggatgaatgctttctatactgtttttgtaatatttttgtaacatttgccatattaaactccatttattttatgggtctgaatcttcactagactaaactgcttgagagaggagcatgtataattcattttcatgttcacaatgctgaaactgatgtctatagagcttcagtatttgtccactgcataaaatcagtaaataaaggcaggaaagtttgttacatcaagtaggaccaagggctagatccattgggacaattcaacagggcttttcattggttattctagctgatatcaacctgccctgacctgaatcaactctgagcccctacctaggctgttgtttcttagcaagtacataataacaactcatcagaatagcagagatcttggtaacaggttgcctgacacttgactgatatgggaaaatcctgaacaggtttggactggaatcttggctcacaacctgtgtgaccttggtcaagatattttatctctctgagcctcaattttctcttctgttaaatgagcatagtgaaactttgttcattggtttgctttgaagagtaaatgagatggtaagtgttggtgtatgtagtgcaggaacataacaattcttgatagatattcattgaatacctgtagtacatagaacatagaaagttcctgttattccactcccacccccacacacttgcccttcaggtctcaggttctccttcctggtacccccagaaagattaagcccctttggccctctatgtgcctcttttatagcatttaacacaattataattaattgattatgtaacttttttatttaatagctgtctcttgtagaatataagcacataaattcagggactatctattaatgaattttcctctagtgcctagtacttaggtggctcacagtaaatgctgattcaatggatgaataactttattcagtctgctcagtgtggcctttaatttagattcaccccaaattactccccatcaggaaggctttcttattcaactttctcatcctcaagattagcaaaactactctctttctattcccaaatatcttctctcagtttcattaccatgatcagaaagtactcttccttgaatttattttctagactagatctattttggggttttcttaccagtgattgtaactattgatgtggtcttttttctgttttttacttctcatatgtgtatctctttccattagtccttcattccttcaacagatactttctgttgtgacagccactcttctaagcactatggaaggatttaaagctgtgtgaagcacagttattccggtcaaggaacttaaaaaaataatacaagtgacaaaacatgtgcaagtttgactaaagtatgagactggaataaataccttataaaaaccaagagcttcagtattttcctgcagttttttgctctattgtattctcaacttttactggtttctcatcaaataaatgtgttaaagtataactcagatcattgcttagatgtacttacttttccaacaaggccttccctgaacatcctatttaccattgcaaatgcattcctctccactagcgccattcttaccctctctttccacatcaatgaatttcatagcacttgtcactttttttcatgctgtataatgtatattaagatattgcttattgtctgtctcccttcaatagaatgtaagctccatgtgggccaggatgtgtagtcattgatgtatccctagaataagtgcccaattatagtagtcatttgatggacatttattaaatgaaattatgaatgaagtagggattggcagttatacactaagactctggaaaaatggcctgagttgaatcctggctttaccattcttggctatataatctcatattatttactttcagcctttcatttcccagatgcccctaccttctagggttgttgggaggatggaatgcataatacatgtaaaccagcaagttcatagtaacaaaagttgactttttaaaaagttaacttactcttctttcctatatatgtgtaaatcatattttattttctcattttaaaaagaagacaataactaaaggtattagcacataatgattcaaaacataatatttccacatgtcgagttgaatgactttgagccagataatatgagttgaaatcagtttaacaataattaaatcagccaagagcagtgtctcatgcctgtaatctcagcactttgggaggctgaggcaggtggatcacttgagctcaggagtttgagaccagcctgagcaacgtggtgaaaccccatctctacaaaaaatacaacaacaaaaaattagccaggtgtggtggctcatgtctgtagtcccagctacttggggggctgaggcaggaggatcacttgagcccaggaggtcaaggctgcagcgaactgtgtttgtaccactgcacttcagcctggacgacacagaccatgtctcaaaaagaaaaaaaatagaataaaatcaaatacacaccatttttgaatatgtcaccagtctgtgtagttcatcttgaaaggacttcaaggtccaatatgcatcatgcagagagttgctagggcccagacaagagtgacttgaccattggcctgagtagttaaactatcagataactagtgaaacaattcggctatttcaacaaacatgttgcatacataacgtgttatgcacagagatgacatttggtataatattatggcaataaaaggtgcagttcctgccttggggaagcaattgtaatatactgtgaggagctaagagtaaagaaggggcccttgtaaatgaggggtgggtcagtagggtagcagttggcagaagactcacactggaataaatgctccttgactcgatattttttttttttcaaaaatgcagaagcattattgaagcccggatgtttgggttctatgataaataaaagatatggatttgagctgctcattaaattttgaaagaaaagatcctaaaaggttagagaccatggagatttcaaagtggctgaccttgattagatataagtgtaagtcagatgggtattcctggggggtcccgactttaatacaatttgaaagtttcatgattatgagcacctctctgtgcctccttggtggagagctgacctatgagtagttactgtgtgaattaatgaacatccttcagcaaaagttattaatagtaatgtttggtaaaagtcctttagaagtagactgttatgtgtgttactagttataatcaattaataacctgtgatttgtaggagcaaatggtcatagggatacagtatacattttaatcttgctcttcaaacatcaccgtagatccatggtccttctcaagacattggctttgttctgaagcagctcccacgctcttccagaaatctctatgcgggactctgaatgtggtcaagaagaagatgtactggatgcacattccctatcaggagtctcttaatagtctcccacccagttacaacatattgctgtaatcccacacaacagctgaaacatcttttcttcatttcttttaattcctgtagcatttgatgtctccaccgtgtaatttacatttaattgtaagttgttttgcatcatttaatagttgtttcaagtatgaatgtcttgccttcccaagaagattaaaataagattcctttaagaacagaggctcactgcgcagtgccagacatagacatagagtaaaccacaactactgacttcacttcaagctgacctaaccatcttcccagcgaagacggccaacctggtgtataactcattcttctgatctgcacttactttatagaggaataaatacactgagttattgggagtttgtgaaggaagtgactagaatttcaataaaataataaagttttgttttgtttcatttcgtttgaaaagaaactgctgcatggccaagatatttgaaaatggaggctgggattggacaggggtgaagaattgtgtcacagactttgtactggaaaaatgtctgccttaatctagtgaataaatatgactgttctttgaagtcctttttttcctccccgagtataaattcaaatgctattcattttctgagttgcctgtatttctttagcccttaaggcatcaacctttgatgtcttattttcataatattttctctcttagaactgatccacatattcagtagaatggaggtataaatcctaatccatagactactccgagcttattgaaagtgaatcttatttagattctttcctttatctgctcactgacagatctaatgttaaacagaaccttattatcatcacaaggaagtagattaaaaaatacttttcagtcattcgtattcaacaagtacactccatcaaatcttgcctaactttttttgcaaataactttgctccttggatcctctcccaggtctttatcaaaatggaaccacatacatttgtaactacctcataattaaagttttgagtcattaagttcagttatctttaagggtaaacattgaatttgctgtaaaagttccatttgtttcactaaaattcgcaaatagttgtgattttctttgcagatctgtccagtttgatcttgaaacaaaactgcttaaaactttatcagccttccttctttttggcttagctttaataaccacttttaatatataactcagatctataaataatactgagaaaagcagtggaaaacattgcaggtataaagacttttcatgttgactatttttggtaaagattctggacatttgagtgaagtctctcatgttttattggtttattttactctggcaccgcttatgaaaaaggggacttgaattactagagggtaattttctttctttattttatttatatattttttactatttttttccttcagttatgttgtttattcaaaacttgaaaacatatacaatttcagggtcttctagagtatatttacatcattctgatgaacaactttataatttttaaattagcaaatattctcaaccctgtcagctttaatattataattaatgtgcacaaatctgaaaacttttcttgctcatactataatacattaaatagaccttagcaaacaacttcttatttgaatacttgtctgtccctgtcactcttctcatactttagcctcataactttggttataattatgtaaatggttaatattcatgttctcattgcaaaatgaaaagtgaggaagagaaattaagccatttgcctaaggtcacaagtctggtaaaatcaacagaggcactcagaatacctccaaaatcatttccatgatgccagaacctttaaatgctacagaaacaagctaaagcgatgcatttaaatgtgcttctatgtagggcttgagctgtatctaaacttaaattagagctcagccaacatagaatctagttcagcaatactctacaacatgagataaccatactgatgtttgatataaaatgagattgcagaggaaacacattttaatacctgaggtgtgtgcttaatcttcttgatgtatattaaaagctcagtacgtgagagtaatatgaggtgatggggtttactcttaaagagattactaataatgtttatttggaaaaagatgaagattttagaggctatttaagaaactggttctgggaaaaccagccataacttaagagttcttctttcacccaatccccttggaattctgctttgctatagaaccatggtcaaaccaaggcaagcagcacaaattacatgaacaaagaatacaacaataaaaagcggatccttaagaccctcccaagaagaccaagagctctctctttaaaactctgtaaaatacctaggttctcaagtcttcctatgtcttatttcttaactaattgcactatcaattcaaaaatggaacaaaggatattctacgtatcagaaccttttttcctatacattaagaagaacttttcccacatgaataggtaatatcacagtctaaagccagaggatgaaacctatgaattcttcctatcatatattttaacaagaaacgtaaatatctatgacctacttatagccaatttatattttgcccaggttgttttgtttctaaacttacccctcatatggcttaataatgaaggccataaatgtgcctctttcctatctcacccctatgacttgacatgtattataaaatgaacttcctatataaaataatatttattgaatgaaaggaaagtattacatacaactttcattattatattattaagcttattttttgcacatcatggctagatcatcttaaaatagtttggctctgtctcttttcccatttttttttttattatactttaagttctagggtacgtgagcacaacgtgaaggttcgttacatatgtatacatgtgccatgttggtgtgctgcacccgttaacttgtcatttacattacgtatatctactaatgctatccctcccccctccccccactccatgacagaccccggtgtgtggtgttccccaccctgtgtccaagtgttctcattgttcaattcccacctatgattgagaacatgcagtgtttggttttctgtccttgcaatagtttgctcagaatgatggtttccagcttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacatgtgcatgtgtcttatagcagcatgatttataatcctttgggtatatacccagtaatgggatggctgggtcaaatagtatttctagttcaagatccttgaggaatcgccacactgtcttccacaatggttgaactagtttacagtcccaccaacagtgtaaaactgttcctatttctccacatcctctctagcacctgttgtttccttactttttaatgattgccattttaactggtgtgagatgatatctcattgtggttttgatttgcatttctctgatggccaagtgatgatgagcattttttcatgtgtctgttggctgcataaatgtcttcttttgagaagtgtctgttcatatcctttgcccactttttgatgtggttgtttgattttttcttgtaaatttgtttaagttatttgtagattctgtgtattagctctttctcagatgggtagattataaaaattttctcccattctgtaggttgcctgttcactccaatggtagtttcttctgctgtgcagaagctctttagtttaattagatctcatttgtcaattttggcttttgttgccattgcttttggtgttttagtcatgaagtccttgcctgtgcctatgtcctgaatggtattgcctaggttttcttgtagggtttttatggttttaggtctaacatttaagtttttaatccatcttgaattaatttttgtataaggtgtacggaagagatccagtttcagctttctacatgtggctagccagtatttccagcacaatttattaaatagggaatcctttccccatttcttattgttgtcaggtttgtcaaagatcagatggttgaagatgtgtagtattatttctgagggctctattctgttccattagtctatatctctgttttggtaccagtaccatgctgttttggttactgtagccttgtagtatagtttgaagtcaggcagcgtgatgcctccagctttgttcttttggcttaggattgtcttggcaatgcgggctcttttttggttccacataaactttaaagtagtttttttccaattctgtgaagaaagtcattggtagcttgatggggatggcactgaatctataaattaccttgggcagtgtggccattttcatgatattgattcttcctatctatgagcatggaatgttcttccatttgtttgtgtcctcttttatttcattgagcagtggtttgtaattctccttgaagaggtccttcacatcccttgtaagttggattcctaggtgttttattctctttgaagcaattgtgaattggagttcacttcggatttggctgtttgtctgttattggtgtataggaatgcttgtgatttttgcacattgattttgtatcctgagactttgctgaagttgcttatcagattaaggagattttgggctgagacgatggggttttctaaatatacaatcatgtcatctgcaaacagggagaatttgacttcctcttttcctaattgaataccctttatttctttctcctgcctgattgccctggccagaacttccaatactatgttgaataggagtggtgagaaagggcatccctgtcttgtgccaggtttcaaagggaatgcttctagcttttgcccattcagtatgatattggctgtgggtttgtcataaatagctcttattattttgagatacatcccatcaatgcctagtttattgagagtttttagcatgaagggttgttgaattttgtcaaacgccttttctgcatctattgagagaatcatgtggcttttgtctttggttctgtttatatgctggattacatttattgatttgcatatgttgaaccagccttgcatcccagggatgaagcccacttgatcatggtggataagctttttgatgtgctgctggcttcggtttgccagtattttattaaggatatttgcatcaatgttcatcagggatattggtctaaaattctctttttttgttgtgtctctgccaggctttggtatcaggataatgctggccttataaaatgagttagggaggattccctctttttctatcgattggaatagtttcagaaggaatgttaccagctcctttttgtatctctggtagaattcggctgtgaatccctctggtcctggactttttttggttggtaggctattaattattgcctcaatttcagagcctgttattggtctattgagggattcaacttcttcctggtttagtcttgggagggtgtatgtgtccaggaattcatccatttcttctagattttctagtttatttgcatagaggtgtttatagtattctctgatagtagtttgtatttctgtgggatcagtggtgatatcacctttatcattttttattgcgtctatttgattcttctccctttcttctttattagtcttgctagtggtccgtcaattttgttgatcttttcaaaataccagctcctggattcattgattttttgaagggtttttttgtgtctctatctccttcagttctgctctgatcttagttatttcttgccttctgttagcttttgaatgcgtttgctcttgcttctctagttcttttaattgtgctgttagggtgtcaattttagatctttcctgctttctcttgtgggaatttagtgctataaatttccctctacacactgctttaaatatgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgaattctagtttgattgcactgtggtctgagagacagactgttgtaatttctgttctttaacatttgctgaggagtgctttacttccaactatatggtcaattttggaataagtgcaatgtgatgttgagaagaatgtatattctgttgatttgtggtggagagttctgtagatgtctattaggtccacttggtgcagagctgagttcaattcctggataaccttgttaactttctgtctcgttgatctatccgatgttgacagtggggtgttacagtctctctttattattgtgtgggagtctaagtctctttgtaagtctctaagggcttgctttatgaatctgggtgctcctgtattgggtgcatatatatttaggatagttagctcttcttgttgaattgatccctttaccattacgtaatggccttctttgtctcttttgatctttgttggtttaaagtctgttttatcagagactaggattgcaaccccaccttttttttgttttccatgtgcttggtagatcttccttcctccctttattttgagcctgtgtgtgtctctgcacgtgagatgggtctcctgaatacagcacagtggtgggtcttgactctttatccaatttgccagttagcatcttttaattggagcatttagcccatttacatttaaggttaatattgttatgtgtgaatttgatcctgtcattatgatgttagctggttattttgctcattagttgatgcagtctcttcctagcatcgatggtctttacaatttggcatgtttttgcagtggttggtactggttgttcctttccatgtttagcacttccttcaggagctcttctaggcctggtggtgacaaaatctctcagcatttgcttgtctgtaaaggattttatttctccttcacttatgaaacttagtttggctggatatgaaattctgggttgaaaattctttaagaatgttgaatattggcccccactctcttctggtttgtagagtttctgccgagggatcagctgttagtctgatgggcttccctttgtgggtaacccgacctttctctctggctgcccttaacattttttccttcatttcaactttagtgaatctgaaaattatgtgtcttggagttgctcttctcgaggagtatctttgtggcattctactagagggtaattttcttttagggtgttataattattttaaaaattgattcattggaatatgttatcaatgtcaaaacatgagataacttgatgattatctctttatgaatttgaggtgctgagtatttcttgtttttcaattacagcattctttcaaatagccagtctcatgtttctatttctctcttagctgcttctttctttaatattttgttgctaatgagaacctctaccaaaatgagtaaccaaagggctgaagaaagttgaactgttaaatggtgtttgttaattgcttcttcaattacagaaggattttatatgttgagtaacatgccatttgaagatttgacaattccatcctctccttggtaactccccagtcatttggtctagattgatccatcatctttctcacttaagagcatttagttctcaccttcaaataatcagcagattaaaatagtggtacatagtcatctgtaggaagaaagaaataagctgtacagtagagtgctctgtgggtaaatatttgttgtgttgagatataacctgtgtatatttattaaatatcagtgacatttctttgcttattctttcattcactcaacagatattattgaacagctgctgtgtactaggcattgttcattttcccaaattctaaaattgtgatcatttctatttttaaaatgtattatttaacaaagtactggtaatgatatatatctttatttcccagtgggttttggcaatatagcataaagatcatgaaagtgggctctagaatctgagagcctgtgaaaacttcagctccaacactttctagttgtgtgagcgactttaggcaagttaatgaacttccctaagctcatttacttcatctttacaataggtataataatagtacttacctcatgtccactatctaaagagtaaatgggaaaatatgcaaagcatattgcactgggcttggcaggcaagtaatccctcaatagatgttaaatttgctgctgttattaaatcatagttcttgcttagttgattgttataatctttttcagtatttattgaacaaatacctatgaagtgtactcagagtaaacttggacagtgagagacaccaccatctggcctgttgtgtcataaacaaaagccttaaaactgggtcttggcaatggtgaggggaacagatgctctaactgccttctagaatgtgtttttcactatgtgtctaagctgcgatgaatgtcactaatgtcatctctctttctattttaggtaagtacatcaccatttttgaaactctgtgcagatgggtaagtcttgctgctggaacttttcctgttgatttgcatacttggaggatctggatcagacagtgtgcttatcgtggtcagaaaatgcctttattttattcaagcagagatctggaaaggtaacagaatttcccacacatgctttccatctctgtttcaaatctttggcagaaaaaaaaaatctgttatttttaattagataaaatgctatgttaaataattgaagatttaatttcttactctgtcaatagaaggcagagtagtttaaaagacttgagaaaagaaaaacaattgtttgcttcctattagaaatcacaaaatcctctctgaagtaaacatacaaatctttgtttttctgctttcaaacagggaaaattttttcagtgcctaacaaacaggtgtttcatgattagattattaatgagaaataattttgtatcaaatagaaaaagtgacaaatggccctgcaagaccatgtgtgcataatattgtagaaggaattcctgttatgactaagagttgatgtagttaatttagtatgtctaaagttggctgtaatctatcaccacagaagagctggaagaaatgatcttaaatcacaaaggatttagtaaagacctacgtgagctgtgaaagatgattaaactatgaaatagttctcaaaaggaagttataaattccttgccacttgtgaaatctaaaaactacatagacagttatgttcgtattagaaaataaagatttatcctgccttggcacaatgtattgaattggcatgttgttctcagtaacaaagtcccaatttgcttcatcagctttaattccctatttactccatacatactctatactctatgtgttagtctgagtcttgcaagaagcccatgccaaaatgggattagaaatgcaagaattttaggaaatgcccttgtagaggaatataaggagggagccagttaaggctgagggaaacgtcaaagcatgatccaagtttgactctgagtaaagaagggagagagaattggtgagagcatccttgattgggctagccaaaggcatatgggagtcctcaagccaaaatcagccatcagaggaatcctgtttcccaggaatgtgtctgccacaacatgccctctgtgctcagtaaataccaggaagcagggcatgggaggtatggccttagctaaaatgttgcagtgaatttcagaggcatcagttggggccctttgctggttatagttcctatagttggaggtctgcagcatatcctcacggccccacacagagactgttagatcttggttctttctgtttcttattttctattacaatgccttctatctccacatcttactcattcttcatgcccaaatcagttaccacttccttcatgaaggttactctgtacaacctagtggctaataattaccattctcttttgtaattcaaaaattcttgtatttttctgtgatatttattgttttttgttatccatttattcaaaaaaatggtatcgagagctgcatttgtgctagccacttttctatgctctgtgggggagaggatcagaaaaaaatgataaaacatgacagtctaatggaaaagataatactgtagaatacattaaaatatgacagaaatgtttgaagtatgagcaaaagatatgaggagacagaagaaggaagaataaccttttgggaaagaagggagggcagtgctcagggagggatggaggatttaaagcaggacttgacattgagttttgtcttggagggtgactagctcgttaggagttgacagttgaataggcatcattttcaagttcatggttatatgaaggagcatagaaaaggtttgtagtacagagagccttgcatgtcatagggaatttatgggattacggtcaaagagaaatctgcaaaattggcctaaagccagattatatggggcatcgggtcttggcaagtagtttggactttattctatgagcccaatccaattcagaacatctcagagtcatgtgggccaggctgaatgacaaaaatattgatgtatataattctgttatggcatactaaaatggtatgattctaccaaacaaaaaagatggtgatactatatatttaaatatgttgtctatatctaaaaactactaataaattacaatgaagaaatcacattttgataaaagaagataaaaatatagggcataaggccaaaatgtaatggaacgatttagcagactcttaatctcaggtgtgagatttgtcacgaatagctattttctgctcgatatatatttactttctgtacagtgtggttataaagacataactgaaaaatctagttgtcctcgaaatatgtaaggtatcaaaaagcaggattttatgctgagtgtgctttataatatttggaaaatagttataactagttgaagcattcaccagaatgtcacttgacaattctaactttaaatatctataagccataaagttaatatattatattgattttgatttttaatttgatgtaatttcagatttactgtaaagtggcaagaatagcacaaggaattcccagatacccctcaccaatatcccccaaatgttaacattttactacatttactttattcaatctctgtctctcatatctacctttctgtctatctaatcatctatgtatccgtctacccatacacacgtttccttattgatacacattaagagcaagttgcagacatgatactcctttgcttctaaatacttaaataattcctaaaaacatggaattatcatacataggtacagttcagtggttaaaattagcaaattaacatggataaaatgttgttatctaatctacagactttattctaaatttcaataattgtcccaataatgttctgtgtagccaatgaaattacaaaatcatgcttttcaatcagttgtcatgtctctttaatatcctttaaactggagcagtttctgagtcttcgtgaaagactatttcatgacatttatatttttggagaattacatgccaattgttttgtacactctcttgatttatttgggctgctataacaaactaccatagtcttcatggtttataaacaacagaaatttatttctcatggttctgaaggctgagaaatcccatgatctgtgctaagcagattttctgtctggtgaggatcagctttctagctcataaatagctgtctccttgctgtgtttttacatggcagaaaggaagagagagttctctggggtctcttttataagggcattaatcccattcatgagggctctgtccccataatctcatcacttccaaaaggccacacctgtaaataccatcatattgctgattaagtttcaacatatgaatttggaggcaacgtaaacattcagtctaaagcatagactatctttcaatttgagtttattttgtgtttcctggggatgatagtcaggtcatacaacttgggcaggaatatcacagtagggatgctaactccttatatccagaggtagatgctgttgtttagtaccattactgacaaatttagctttgatcatttagttcaagtggtgcctaccagatttctccactgtaaagttactattttcctcctttgtaattaaaaagcattttgtaccatgataatatgagagcatgtaaatatgctgttattcctcaatttcttacccaatagctttggaatccgttggtgattcctgtctaaatcagttacttgtgttattatgatggttgctgttttcattggtttaatgctgctgtaacagataccacaaactgggtaatttataatgaatagaatttatttggctcatggttctggaggctgagaagttcaggatcaaggggctgcatctggtgcagtcctttttcctgctgcatcatgacatgatgaaaggtatcacatgggcaagaaatagggagaagggggccaaactcattttttttttttttttttttgagacagagtctcgctctgtcacccaggctggagtgcagtgactccgcctcggctcactgcaacctccacctcccgggttcgccattctcctgcctcagtttcccgagtagctgggactacaggcacccaccaccacgcccggctaattttttgtattttgtttagtagagacggggtttcaccgtgttagccaggacggtctccatctgctgacctcgtgagccacccaccttagcctcccaaagtgctgggattacaggccttagccaccgcacctggcccaaactcattcttttataaggaacctactcctatgataacagataaagtaatccattcatgaagggaatgctctcatgatctaatcatctcttaaatgtcccaactcttaacactgttgcgttttggtctaagcttccaagatgtgaactttgggagacatattcaaaccatagtggtttgctaaggggaaatcttgtaatttcatcatttcttcctcttttattagttggctttctattatgcataaaaatgtttcttcgtgcttgtttctgtgtggagtcatgaattctttatttagcaggttgttatcctttaatattgttggttaatatcattatttatcttaatcctcatactgtcctggatttggacagtacaaggtacttctagttgactcccttgtcattttaacacgttactatcattctttgagtacttttttactttttggttttagatatgagactcttgttcttttatccaagccttggaatcagctacttttatagggctctctgtttcctttcagtaaagaatggtttttagaaatcaaaatttggagagtaggtgtgcttttgcttctaggtccttttagtagacatatctagggggaaagtgtatgtatgtacatactcatatataaatgtgtgcatatatatgcatacccacacatacctatatccatgggtatattcagatatttgtatacattaaacctaggatttcacaatgataatccatcattgcagtgctcattctgttcttctccattttcgtatctgtaactctgtgagaagttacggtgagaagcctggctcccattattcacaatatattatatattgcataggattttcttacctgtggaatgtggtttcaaaaattactttcagaattacccactcacgcctctatggaaaaagagaagtaaggcaaagaaaagtatttcagtaagtagacttttagcattatttatgttttatatgcctaattctgtactcaaaattcacttggttagttcttttctcacagccacttccactcacttcacggttctgttacttattttaaatatggatcagttaatttgttttaatatataaatttgttttcatctagagttgaatcgattaatctggaatgatattttctgtttctatgtttaaaatatcaactaataatttcctttccttaataataagaaatctctagcaccatttaagactcagttaactgaggtgtaggtatccatgttttcctagagtatagagctgtgatctaaatcagaaaatctgaacaagtttgtcttggaccaaacttcaggataatctggaaacaacgggacaaatgttagtgcatgagtattttcaaacatagttctgagtaaattccaaatgcatatgtgggtttgtggctcttcatatctggttatttgtacatgatcacatctttattgtagataataaaagttgggtataaaagcaatgccattaattatgtattttttatgctttttgtttcaaaaaaggaattaagcaatcctaactttaaaaatggataaaatgcctatgtaaagctaagttagaaacacaaatgtaaaagtgtatttcgtacttggagttaagtttaggtcttaaaatattaatagcttcctcaaagatacagcaaatagagaaacctgataatatttatgtcttgagagaaaattatctttctataattaattataagacttttcattagggtctttgtgtaaagtaaagcaataatatgtttaatagtatttttatgtgagttacatacatgtacattattaatcatgaataaatagtgatgttcttatacttagtcttgttataagtcaaaatattaaatcattattccatgaaagtcttcatatagtaatttaaatcattgttaagtctggttacttgatgttgagaaagagcttagtacacatagtagaatgacttgccagccttgccattaggttatctttctcatacattacttaccttaagttggcaggagcttgattacagaagataactgtcatttatctctttgtgtggagtgcatatattgtgggatgtctataggagtattacccaaagggtttgtattacagaattatagttaacaaaatcactaggaaatgtttatggagggaagataaccacagatatatctgattacctatttggaggactagcagtggaatttcttgctgtttctcatgtggccaaaactaataaaataaaataaatttagaagagttttgttgtaccaagataatccatatatttcagttggtatggaaaaacatcttttctttcagccattgttactatgacacttagacactctagtctacaaaattatcctaggtttagcaatattggaattaaattttattgttccttcctgattgcagagttataaaaataaggattgagttattatgagaggccgattgtgtaatacatatcatgagttaaaagtaaacgttgacttttattataattgccttttgccacatgagagaaaataaactaagtgaataagactgtctctaagtcttctctgagattaatttgacaatttactagaaatagaaagattggtaatgctcagtctaggaaaggggtaaagaaacaggcacacatatattacttgagagattgtaaattttgtacagttacaatggtaacactccatgtcaaaatatgcatataacaatgcctcttgtagacatttatcctcaagtaacaagaagtaggcaaagattattttatgtattttgaccgtcaatgagttgataatagtaaaggactagggagggttggtgtttaaaacaggccaggtgcggtggctcacacctgtaatcccagcactttgggaggccaaggcggatcacttgaggtcagaaatttaagaccagcctgaccaacatggtgaaactccatctctactaaaaatacagaaatatccaggcactgtggcaggtgcctataatcccagctactcaggcgcctgaggcaggagaagtgcttgaaccccagaggtagaggttgcagtgagccgaaatggtgccactgcactccagcctgggtgacagagccagactacatctcaaaaacaaacaaaaaactaaaacagactaaattgtggtacttccatattttttttaatgatagagatattagcattgaaatttgtcacaaaactacacataatgtaattctttacacatttttaagtatatgggctaaagtatgaaaccaactctgagtaataggattataaatattctttatctccttgtatttatatttatttataccttaattaaattttgaaataatgttgttacttttacaataagaagttgtgaaaaactattaccatgaaaataatctagcaagaatttgatttaacattgctcatttcttgaaagcaagccaagacatttttttttactctttttgagactgagtttaaggtatttgatcaattgttagaggatgagtttatcattttagtgccttgctgatttgtgcaggcacctcagttttaagtaatcatgggattatttatttgttgatttagcatttgttcagtacttatgtgcttaatagcacttgaacatacaaagagaaatgagatttttggtccccaagaattaaaaatttaatggaggagataatcataaacttacagagaagtatatgataggctgtgtcaaagtgggaacaatgtagactagggaaatacaatgcttctcttggatgggtcacacctaggaggggccaaaggggacaactcactgggtattggaatgatctggatccctggattacttggttggtgctgggctgattcggaaaccctttctattttcaactcttctgctaaacatcattatagtaacatcagtacacatcctgctgttaccaagtgtcagtgtttggtcagtttgagttttacaggcatatagaactgccattttgtcatttctgtctacattgtacaaaaaagtaatttaactgagctttataacttatgatttggagaactccacagctcccgttgttctttctcaaaaaattattttcagtgcaacttagctttctgtgtatctccattgctcatctgccctagatggttcaggttggttgctgtctctattagtgtgacaagagttaataaaatgattaattaaaaagagccttaaacgtctacttagaaaacactagataaatgctaagtagggtgctttttggtggatcaagagagtccagatcactaatatatggatggcgtataaattaaatcactgtgtaagactgcaaaatgtcagagaaacattttaatatgttccccccagcatttgcctttctgtacatatgtcttagaattataatgcctacattttaactatggttttctgtgggtatatatacaaatagatagcaactgattaaaaaaaaagatctcaacttttttttttcaattcacaagattggagtatttggagatagggctgttttttctctttttttccttttaaagccatccacattttcttttctactgctttctcactcaaaaaatgtaagctagaaaaagttgatctcatggaagtaaaaaggagaacagagattactagaggctggaaacagtagggagaaggggaggatagagaaatatttgttaagaatacgaaatgacagctagataggaggaattaagtggtagtgttctatagcactatagtatgactatagttaacaacgatatattatatattttcaaatacttagaggatattgaatagtcccaaagaaatgaaaaatgttggaacatatgctaataccctgatctgatcactatgcattgtatgtattgaaacatccctacgtacaattattatgtatcaatttaaaaaatatctaaaaatatatgtgtacctaagtgtatacaccttatatatcctttgatttccttatgaaacacagcatagtttgagatttaaaatgaataaaatggttctttatgctctgtaaaattagaaaatccttcagcttttagaagctctctgttggtttattagttgatcacaaattaatatgtccctttggtttaatctgtatcataaaacaaaagttgactgttcccaaacatgtgcttggataagagaaagctgttaataaatatctattgactgaatgaaagtataaatgaataaatatttttagcccttagaaatatgtgaaaaatacctagaaaatattagacataccaaggtcaatgctaaatgtaaaatgtatttctaagaaaactctaagtatgcaaccatatggattgattaaaactagttacttaaaacctcttatgactgtatttttcttgtttttgaaaaataaatgcagtttgcactctccttgcttagaacttacgtattctatttcacaaaagtgcatgcttgtgttattaaatgtgtgtgtgtgtgtgtgtgtatatacatatacatatatcttgatccctaatctcagttagctccaaaggtgttctaaatatataaatgttataggtcacagtgtgatctcttaacactatattttttggttgagtgtggtggctcatgcctgtaatcccagcactttgggcggctgaggtggaaggataattggagcccaggattttgagatcagccagggcaacatagtgagaccctgtctctactgaaaatacaaaaaaattatccaggtgttgtggcacgtgcctgtagtccctgctacttgggaggctgaggtgggaggatctcttgagcctgggaggtcgagactacagtaagccaggattgcgccactgcactccagcctgggtgacagagtgagagaccctttttcaaaaaagcctacgtttttcaccaacacatttcaaaattacttttaaaattattattgtttttaaagataggtatgtgccaaaattagaactttgggtccaagagcatctccacattcacataaagaaacttaagttcagtaacttgctcaggctataaagtagaagagttaggatttgaacccaggtcagagggctccaaagccctttcactttccatcaaaaacatttgatattttgccaaaaatatcatgactgtttgtccattgccatttcatatccttcaaacagctataaagtgtggagaaatgataacttcataactcacgctacagctcgcagacacacttaattagcttagggacaaacagttgtgacattatgagtgggagttgcaaggctgagttgaatgtactgatggggatgttggttaaaaacaaaaagccattctattctacatcgtggcaatctttgtacttcaaaagtagtagtattctgagacgtttactgtgtattatagatttgaatcacaattcagcaatactagagaaggagaaatctactttttctaaattttctctacagtgaaataaaatgcttttggaatatttacttgaggaatgggttatctgaatgttctcactgaaactcattacaccgtatagtgaaaatctagttacaggtagttgaagtgtaggtatagatagtatgtgattcataatgacgcatgtatgccatgatttacctcagtcactggacagtaagaatgtgattaaggaagtttcctctgcaacatttcaagataagttagctgttttgagccacacaaatattaaactatgcattgtggccaagtgcctataatgccaaaagcacctgtttcaaattgtgagtaatatcttatgtgttacactattgaaatctccttgttacagaatattaatactacctattgaaaagagtaagaaataagagtttctcatttccacccttttggatttatttcatcaaatgatgtgttgatgaataatgccctttctgtaagatggataactcatggaaagaaagccatttggacatggatactcaagattttaaagaatttaggaggtggcagtgtgaatatcaaataaggtgccacttgtagagagagtatctcagaaaaggagcagagaatcatacaatagaaaagtgaaaagctgtttcctgtggtagatagactctaaataatgattttagagacagacataataaattaatttattggttcattgaagaaacatcctgagttcctatgacatgctaggcattgtgctggtgggggcgagggttgggtgagtagtggcgtatggagatgaaaagatgcatcagacatggtccttgtcttcatagaactttccacagggtaaaactggaaaaaccctgctgggacagagtgggcatctattccggcttaggcaagcatatcttatcctattgatatctgtacaatattatccttaaactagaaatacaataatatgttttattctgacaatgaggaataattttccatattaaggaataggttaatctctaaatagtatgctatttattttatcttactttttcctctgtgtttttaaatatttaacaatttaggtagcatcctagcagggcatcactagagaaataaaatgaagcatttttaagtaaatatattttacagatcatttggaattgtttcaaaaacttcattaacttttaatgaaccaaaaatatagttcattggaattaaatgttccatgtgaagatatttatttcggaaactacatgactaaaccaatggtaagttgaagttaaaaaagtgaccccaagagagggacaatgtcatattattattgttataacccatatatgtttaataatgaccatgcaggatggtgcatatagcaaataactaggtaaagtttctaggaatttttattctatttctcttctttcaattctaatgtatgggccaactcatcattttaatacagagctttgagagaaaatgcataaatgtaattttctgtatgatcactagatggcgccatgcttcccttagaatgaagctgctcaggaatttgcaagtgcagttctgagtatttcacatagaaacctggaagatgagacaattgtatttcccataaggttttgattcactaatatcatcaaaacaacaattagcacgtgttactttgcattcaaaaagggagtaacgattgggtttgtaaacagtatattgaaataatcattactgaggacaaaagtgaagcatgcctctaagaggtaattcggaaggtctcttttgctttccaaaaacatactagtaacaaggaaacatcttatacttgcttggaaaactgggtcctagtcaatgagctatgtcttaaggaatggaaatactggcaaatgtggtaaagtttacatagccattttctgcaaaccaagaagataaattgcattctgcctagtcttaggcaaacagttgggccatttactgttccatcaaaaaaaggattgtcagatccccaaaagcacaaggatgcatatagagtgtccatttaaacttcctgatcaaagatatacactcgtgaaggtggagtggaagacttctttataggagtatgattcatgtttataaaattggagacacttagaaagttgagttaaaagtgactcaaaggatatcttttcattgccctttttatagatggaaaaacatggatgtagctgtttcatacagctaagacactagtgcatcaaaacacaatacatttgtgagacatcttgttatgatttcaaagcagtttgtcaataaatgtgtatgttcaatggttacagtttgggatggtaagacatcatcagctcagaatagtaacatccttccctttatcttttttatagaactttaaacctggatgcaattttaagatcatatgcatcattttttctatatggtgattacattctagataaattaatttgtgatacactctggactttttgtattacatcaagttgaagtttccttttgtggacttagaaacaaaaaatttgcagtaataaaaatgaaaagagattatgcaaaaataattactaatgaccatgtttcttaggtgatgaatttaattgagtgttggtattttaagaatacgtgcatcaagcaaattataatgtaaccaaatatccagagatttgaggaggaatatcaggttattatcacatttcagagctgaatttttcttctttggttcattgactgcattgaatctttgttttgtgggtgatataaactttttcatttcattccttgctctaggagtgactctggggaatcattaggtacatgcttgttggttttccataataattatctctgagccctaatggtttctggatttggcctctcttcactttctccaactttaggcaggagttcagaatggccttcagttgcaaagagaagtataaatccaacttaccatctagtctctttctgtgtggtcttggcaaattttttaatcctggctaggcatgctgttactggcagaaatgaggttctgcctcaactttagctccagccctgccgttagcctgaagactttccaagatttagggagggtccatgaatatctcatcttcaagagtgtgctatagagttatcgagcaactcagatcttttaaaaatcttgagtttaggaatcatacatttaaatgtcagttctcctagaaaatgaagattttaatcctttagaaaaaaatctagggacaaggaattctagcatttcctaaagattccatcataagtagtgcttttaatgtaaagggtttctttgaaaaaaattatttctttactttttttttttttttccttgagacagggtctccctttgtcacccaggctggagtggagtggtatgatcatggctcctgcagcctctacttgctgggctccagtgatcctcccacctcagcctctcaaatagctgggactacgggctcacaccaccacacctgtctcatttttgtattttttgtagagaaggggtttggacatgttacccaggctggtcttgaattcttgggctcaagtagtccttctgcctccatctcccgaagtgttgggattacaggtgtgagtcgtcatgcctggctgtaaaattgtattatatttctaatatgaagaaatacttggtttctctttactgtttagaaagataattatcatgattgttttctttattaactcctatatgatactttgtatttttatcccctgctactcaccccaagcttatttttataattagaaaggaatcaagctagccaaacaggagttatccttccttaaggtagagaagttactattttttttcaaatggcgatctgcctgcctgagttgctatttggatctctgatgatttcttcctttgatcccctaactcaaagcaggcaatcaaggctatgctgttagttgtaaccagatggaaacctgatctccatttatactttgcctcttgtattgataacaggacatgaaccaggatagatacactaacagtatttgactctgctgcagttgccaggctaaataaccagaactcatatctcattctactctacctatggaaacactctgtataatgaaaatgtgtgttgaaagtgtgtgggtatatgttgtgtgtatatgcattaaaattctcattagcatgggctggttgtaatagtgcatacctgttatcccaactacttgggatgctgaggcaggaggatcatttgaacccagagttcaaggccagcctgggtaacacagcaagaccgccatctatttaaaaaaaaaaagtaaaaactctcatgagaataataattaaagtagctatgttgatcattgcagtaattaaaccaaaatattaatactcatacctgatatagttttttccactttattataattacatttctctcaaaaaatttaagaattagtatatgtttaacatatacaggttgaatatctcttattgtaaatgcctgggaccagaagtgtttcaacctttgaattttttttttggattttggaatacatgcatacacatagtgagatatcttggggataagaccttcatctaaacacaaaatttatttatgtttcgtatataccttataaacataggctgaaaataattgtatacaatattttaaaatgctttcgtacgtgaaacaaagttttggctgtgttttgactatgacttgtcacatgaggtcaggtgtggaattttccacctgtgacatcatgtcagcactcaaaaagttttggattgtggaacattttgcattttggattttcagattaatgatgcttaacctaccttgtgaaataatggagtcctttattaataacaaaacaataatagatgatacttacagagtacttgtgtgtcaggctctactctaaacattttatatgtattaaaccaattaatcttcacaaaaactctgaattagatatattattattatttccatattttagaggagaaaactgagaaacaagtaatctagtctgtactctaccataatgctatgttacattctatcaacactcccactgcctcttctgaattcattgatagtggtgtggtggcatagagtccacagagtggagcattaattaattttgcataatgtgaaagtaaaacttaagaaaattttaaggaatagacagtgtgcagtgttatggaatcataactatacaattaaggggttaaatgaaatcatgcccaaaatgctgtgttttaaatggtggcactgactgataaaatgtagatttgagttatttattgtttctacattctcaagtgaaaaaggaagaaagtaggaataaaattctggactattggggggggtgtctttagtcttgcaaaaagtaaaaaatagaaatagaagaaagtttttatggttcatattgtaacatcaaaatatggaatgaaaactgtggtctcccatgaagtatttcaggtgctggaaggaaatctcctagactaggactctcagcaagtccatggttcctattatgtccagcatgccatagaaaaactccagaattagttaaattttaataatttaatggagaaaactaatttttcaaggggcagctagttaacttcagcatgagtcaaaaagcacttcatctgtcaatatttatgtaaatatttattttgaattatacatttatttagagtatttatttacattagaatagagggaactaaggccgggcacggtgactcatgcctgtaatcccagcattttgggaggccgaggcggacagataacctgaggtcgggagtttgagaccagcatgaccaacatggagaaccatgtatctaccaaaaatacaaaattagccgggtgtggtggcagatgcctgtaatcccagctacttttgggaggctgaggcaggagaattgcttgaacctgggaggtggaggttgtggtgagcagaggttgcagtgagccaagatcgtgccattgcactccagcctgagcaacaagagcgaaactccatctcaaaaataaagaataaagggaactagccatctgatcatattacaaccaaagccttttattttcttcataacctaactgaatgtgtcaaacagtttgtgattctgtcctccaaatatgcatgtatattccaaaagaatctgtgaccctcagtaggcctgtttttaagtcagtgaactaattctttctttctttcttcttcttcttcttcttcttcttcttcttcttcttcttcttcttcttcttcttcttcttcttcttcttcttcttcctcttcctcttcctcttcttcttcttcttcttcttcttctttcttcttcttctttcttcttcttcttctttcttcttcttctttcttctttcttcttcttcttcttctttcttcttcttcttcttttttttcttgaggcagggtctcactctggactctgtccaggctggagtgcagtggtgcaatcatggctcactgcagccccaaactcctggaccgaagtgatcctcctgcctcagcctctgagtagctgggactacaggcatgggccaccatgtctagctattgttttaaattttgtagagaaaagatctcactatgttgctcaggctggtcttgaacttttgaactcaaccaatcctccagccttggcctcccaaagttctggagttacaggcatgagccaccatacctgctaactaattctgaaagataagtcatagtattgaccataatagtgatgaaaataagtggaatcccaggaggaagcctcatctgcatgtggtgaatatgtaacagtaaagaggatgatcatagtaaggctttctactgtgcatagcatgttagcttttactcttgcttttacatattcatctcatttaaagtttttgctcattttaattattctatgatagatatgacagaggcagggaaagtattatcctcttctccctttactcccaattacagaggagtacctgaatcccacagaattgacatatttcctcaatatcagttagtcaacatcaaagagacttgaactgctatagtcattatatgcagtcttaaggacacactctccacattttaaggtttaaggatggataggatttccacagaagtataaacagaaaaattgaagacagaggaaagaatactggacaagggcaaaaaaacaggaagtatggtacaacttggagaaaatgccagtgagctgctaagctcaggtacaggatgaagagaattagcaggcagatgttgatggaatgccgcaggaagatccatcttgaatggtttcgtgggaacatagactggatgtgtgatctaagaaatataagactagtgggttagactcagcaaggggtaatgtggagctaagtttgatgactatagatatggaaagactcagggacagatgctacagaaatttcaaagttttgataccatattacacaaactaatatggcgcttgaaaaagagtgagacatctaagatgattctcaggttcgggtctgaatgactgggagaataatgatccaggaacagaaatagggaaatcatgagaagatgctaaattgggaggagatgctgggtgtgatttgctgagtttgagtacaagcagaccatgcaagtagttatgtctaacttggaagcaaagtaatggtgtgcacctgtagtcccagatattctggaggctgaggtgggaggatcaattgagcccaggaggtcaaggctgcagtgagccatgatcccaccactgcattctagcctgagcgacagagtgagactctgtctcaaaaaatgtaatgcaatgcaatgcaatgcaacgcaacacagcaaaacacaacacaacacaataaaaataatgccttcagaacctcccccccaaaaaaaaattctaggagggaagtggggtaagcctagtgaaaattctcaggctaactgacaatgtgtatgttttgctaaatggacttcagttggcaaatcaaatttttgagttagacattaataatattgaaatgtaatatccacccacattgtccatttcatagaattactctgtttttgttgttcattttgacatttcctaagctgtcacttgacccagactgacacattatcatctgcatgcacctaggctctgccttatatatgtttacaacatgcaatgaagcctagtgcctgtaatcagaaagagggtgctgcagtccatcatgtgaaaaaagagctggactatgaatgaggaaacagattttactctgacatcaaggctggccgacagcatctgtcatgcccctaacacaatcatgctaattataagccatcactttcattcttcttggaattcagaagtcaggagggttgtaggggcaaatttctaacgggttgtggaatctatcattgctaggaccttttacaattcagttgcttactctttttaaaatctgccattcagcagtctttttcagtaccagtaagccacgctatgcattcctatgaataaagtgcacagcaacagcatccaaatgcagtgacggaactgtatggcttctccttggaatagcttttaaaaacctgcttaggcagggacactttattgcttgctgaaaaattccaaaagatttgtgactatgtttaataaattatcaagaactatatagaattccttagaccttttttctaaaataaacttttggagattttttgtttgttggttgttactattatttttagagaaaggacaattaaattatcttcagatcccagggaatggtagaattagtctttttggcactgatagtaaggtaggtcatgtcttagtccatttggactgttacaataaaatatcataaactctgtagcatggctgggcacagtggttcacggctgtaatctcagcactttggaaggccgaggccggtggatcacctgaggtcaggagttcgagaccagcctgggcaacatggcgaaaccccatctctactaaaaatacaataattagccgggcatggtggcgcatgcctgtagtcccagctactcgggagtctgaggcaggagaatcgcttgaacccaggaggcagagcttgcagtgagcagagattgtcccactgcactccagcctggccgacagagggagactctgtctcaaaaacaaacaaaaaactgggtagcttataaacaatagaaatttatttctcatagtgctggaggctggggagtccaaagtcagcatgctacagatttggtgtctggtgagggccaggtttctggttcattaatggtgtcttcttgctgtgtcctcacttggaagaaggggcaagggagctataacttggaagaaggggcctctttaatatgtgcattaatcctgttcacaaggctggaggcctaatgacctaattacctcccaaaggccctacctcctaacactattgcattggtgattagatttcaacatttgaattttgggagggtgccaatgttcagatcatagctggtcatttcagcttatttgtactctctaagttatgctgcaataattgttggcttctgtacatgggcaatatggaaattaaagcaatcataacattttggtagaggacctgaggagagattattctgaatgtgatgaagttatagtctttttcctcaggtggattagatcactttttggatagaaattttatgttgggaaaaataaaaatggttcagtgacctgaggcagaaaaagtctgttcacaggaatataagataattactccatcaactcacagttgtttggaatgtcaggatcaataatagtcctcagaacattgtaaccttactccagcaactatgctaacataaagcagagaagtctgaagtctgtccattagtattggtgacaaggtcatggttgcttttaaactttgcttgccaaaatacctggagggaactcaatgtgcatactcaagtttctgctgtggcaaattgactgttgctaccccaggagaccctaggaagacaatcagttcatgtctgactggagacattgcaactttatttgtatgaactatttgggtcaaatttcagggggacatgtcactacagaggggcagagggtcatgataatgaaaagaatcattacgttatattggtaattagatgtatgactctacaaacttgtttttccttgggtgttagtaacattctttttggagatagatggcattttacaaagtctatccacagaaaactggaagtatctaaagataatgataatgacgagaatatattcattgtaatctggcatacagaattttctctgccatttaagaagctgaatttcttttaagtatagaaaggttagacttatcaaccttatttgcagatactatttatgtttttcatgttttctctctgtccttaaatattttctgagatttaggcactgagctctctgctagacattttcaaattttatcttttaaaaaatcagaaaacctctctttatgaatgaaatttttcacaaaactctgatatataaaacaggcaaaatgaaaccattatggcaggaatgagtctgggatttgcctatttatttttctttcttctttctcctgtctgctaaattttctacaagcaaggcaagcagttcatgaatcaactgttgactacttctgaaacctaaaatgaaataatatatatgaaagctgttattcagtgatttatacttatcaaaatatacttgtcaaaatattaactgatttgtgtttgtcaaaataaatatattcatacatagcaccttggtaaatcacagatctagttgtattgtaggtgcctagaccaacatgacaacttgattatatggcttgagatatttacatcactcttaccacaaaaacgtcaataaacagagcttattaatcttttgaggaggaggaaatgaaggtgtaggaaagcatgtatgaagttctacagcatttgtatacatccatctttgggaactgagtgagcaaaaaagaataaaatgttgatattagcatgaaaactctcactaactctataaatttcttgtcaatattaggcctgtttctaaagccaatcagaatgaaggaagagctttttaaaaataggcaaatgttggttacattggcttcaattttaaaacaaagttctacattctcttcagaatgcgaaggaggttgaaaaaggaggcatttcctgcatatattttgagatgagacgagggtgagaaaaggagtagagctgaatgttatgttattctgttaacctttgtcaggcccatcaggctttatatggttcaaatttctgctgtatattttgatactttctgtctccacagcagttactcaggaatatatcccaataatgacactgaaaatgcagtgaatttataaatagatcccgctgctgcatagattccattatttagaaaattatacagcgttctgtaggaggttgaacatacagtaaaatagttcatttgcttagaaacaattattataattgttattataaaatctaatagattattagaaatatcacaatataatcaagcaagcatcagactaaataaaatgattatttaatatttgcttcatatgataaagaaaaacttaaaattgattttctatttgaaaaatatcaacagaggctgggcacgatggctcatgcctgttatcccagaactttgggaggctgaggcaagcggatcacctgaagtcaggagtttgagaccagcctggccaacacagtgacaccccatctctactgaaaaaaaaaatacaaaaattagccaggtgtggtggcaggcacctgtaatcccagctactctggaggctgaggcaggagagttgcatgaacccaggaggcagaggtcgcagtgaggcaagatcacgccaatgtactccagccttggagacagagtgagactccatctcaaaggaaaaaaaaaacaaagaaaaatatcagcagaaataagtgagttgagtaatttctaaatcttatttcctatgtaagtggttaagaaataattaacttttgttctagaagtattaaggagacaaattgcaaaatttaatgtgaagccttggctcacaataaatactttctttaaacttaggatatatttaaagtggaataatattttccaacttaaaatgtaaccatttatttttttctttaatgtgtttgtgtatacatctccttctttgtcaaaggtttgagtagaattagaaatagctgcaatttacaaaactctattttgaaaggaagaaaattaataataaatagcagaagtaaaagttatctttctggaatctaggactctcacccactctcatcttcaatatttaccccattgtttcacatatggaatattataaaattaaaatataagagaacggatatgttattattcaaattattttcattgagggtggtttgcccagtttcttagaagcaattaaaaggagaggataaggtggttttcttaaaatagtgctttctttctgctgaatttatgtaacttttttaagaatggcaatctaagtgtacaaatgatgtttaattctcatgagatttcattttaaaccttgctttagagtaaactttatgagtaataagattatacgtgtgggaaactgaaactaaaaggattcaaatggttttgacaaacaacagatattcagggtcagtgcaaataaggttacagataatcactccatctgctccattgtcagcaaaaatgaggcccaggtgttgcagtataccttgtcctttctcctgaattgtgaccattgacaaataagattttcaaagagaagtctgaattccttagggtttagcctgagctcttgtaagagtttctttccagccaaagtattttcttgttttcctgtcaattcaatgggttagaccattccatccattagaagaaagtagaggaaatggctcaaccttgcccagagtacagctggttggaactctgacaacggaactgtggcccagggtaaagagcaagaggctgggggaagcacgtaatgcttcttaaagcctttgatctaaaatgacagactgtcatctccactcacattccattagcccaagcaagtttgtggctaaccagacaatgggtctcagcaatatatcccccctcccagaacgcctgaacattcaagtggcaaaagagtgaattgttgagaacaataatatagtctataatagcatataatgttcataaaattagcaccccaggcaaacaggacagaatgcctatccccagccacagctttatcctggcctacaatgctcatttatactttctttcctgtgtgaaatgaactacacttagtttattttaacctgatttttacaaacccataaagaatgcaagagatgcagtgggccaggaagaagtgagaatgttgccctatgtgtgattttttctagaatctgtctaagttctgctttattcctggatatcttgatatggaaaattaataggattgcatggtaacttccttatacacaagtttatttacctaatttagctcaggagtatgactcaattactagcaacctaaacatgcaataatgaagggaatctccatgttgcttatgcaaacatctagagtcatatgtcactttgtaagtagacaaaatgtagggcatgtgggctggacatgtcaacatgctgctgactttatctgtcattaatttttgttgtgtaaattagcatcctaatgacacacccccactgtattcattctgtgccctgtctcgccccttaacttggagcaggtaatggagtttttaaacatcatttgataatttgccctcttcagaaagtaatactaaggaaaagctatttaaagtgagcagaattccttttatctgttgatttagaaatattatttatattgccagaaatttaaaatgttcaacatgtttatagttattaaaactttgtaaaagtaaagtatgttaaatcttcaggagtatcactggaggagctagatgacaaaatatatatatatatatatatataatattatcatgaaaatgcagtgctggcaaactgctcctgggattataaatatatcagtaaaaccaccctttctcctgtatcctttcagcattagccataaaatagactggccagtaggggttactcttggcattatgatctaagagtggtagattagagtttgaagacataatgagtggtatttttaaaaatagctattatcgttgtgaatttaggtgcaatattcagaattcagaattggtgataacttgctttgagcactgtttcagcagcttttatcctattcatatgactgtcagacatattccaggaactattttacttagccttgttgattgtccctcattaaataaaatccacaggtcaaaattgtaaagtagccttttagttcaatttggcatctttttttcctgggtgatattctcagtcccaggggtttgaattccagacatccttgaaaacaaagccttatatgaatgtagtcagaactaactctttaaaaggcaaaagcacaaccacattcagttaccctaaagtaactgtagtcaggtggctcttcaattttagaaaataaattactttcaaaaagaagaaattagaaaagggaggaaaaaaataatgaagcctcatggacatttgtttttgagagagaaaaaataaataaaaggaagtggttttaaatattggtttcataaaaacaaaacttagaaaagctttttgtctgaagcccaaatggttacaaatgagctctgcttactaaacatggggcagaaagagttcattagaataaaatactattaccttcagaagaaatatgtattaccaagggatgaaatgcaaaagttactaattcaatatttatttatttatttatttatttattttggcgacagagtgagactctgttgcccaggctggagtgcagtgctattatcttgactcaatgcagccagcctctgccttctgggttcaagtgattcttgtaccttagcctcgtgagtagctgagtctacaggtgtatgccaccacacttgactaatttttgcattttcagtagagatggggcctcgccatgttgcccaggtgagtctcaaactcctgagttcaagcaatccacccatctcggcctccccaagtggtaagattgcaggcatgagctaccatgcccggcctacttcaatatttattttttaataaatcaagtttgttatgagagagttgtcagagaataggaatcttctaactgctggtatcttgatgcattcagagctcaaggatgtgtggtgtggttcagaccatttcgtgcacactgtagcagaaggattgccctttgatggctgggcaagggaacattatgatagatgagttatcaaaatattgctaaaattctttaggcagtttgatatagatgttactgtagctggacactgtcagagaaaggagatagctgtaacagagtaccaaatgaaaaacatttttgaatagactgtccttaagacttcttacctacgaagactcctaatctcttcttatgacataattatcggaaaggcctggaggccacaccttgagaagaaaagcacttatcagttgtgattttcattttcttcacagttttctccactcagctagcttacagaggaaaccaaaatgcagttggttgtttctctttactaacactcagttcctaagtgcttagctttagaagttttttctgcctgtttacttccacttcttgtgtgacataacaatattttagggttttatttttcttttcaaaattcttctggtctttggaaagaaaattaagacactatttactctatgtttgctgatgcagaaccagtaagtttgttcacccacccaagtgattcattctaagcaaattctcccattaggcatttgttgcaaatctgcaaaagttgcttttatttactgattcaacatatcccttcccagtataaggatctcctttgacggtgaaaatctccttggattgcataggttttcattgtacagagaaggcttgaccttaaaaatttaagttgcattaaaatttcttttatgttttagagagacagaggcactctgttgcccagactggagtgcagtggtgcagtcatagctcaccgtaccctcaaacccctgggatcaagtgattctcccacctcagcctcctaaagcattggcattacagatgtgagccacctgcttggctgaaacttttcttgaaacacacacacacacacacgaacactcacacacacttttttatttataaagatctcaaccaactttttaaaccatgcaataaaggaatatctttggcattggcaatgtatatttgttgactgctggagtcctttgggcaacatcaaacacccaattgctcattttaaaatctggctttccacgcctgtaattccagcactttgggaggccgaggcaggcggatcaccaggtcaggagatcgagaccatcctggctgacacggtgaaaccccatctctactaaaaatacaaaaaattagctgggcgcagtggcgggcgcctgcagtcccagctactccagaggctgaggcaggagaatggcgtgaacccagaaggcagagcttgcagtgagccgacatcgtgccactgcactccagctggggtgacagagcgagactccgtctcaaaaaaaaaaaaaatctggctctccattttgggttcttaggtagatggaatagagtttccagacttgagggttttaattcagcaacccaggatcaacactttctaggtgtgagactttagtaaataatatactcagagattcatggtttttttttaatctataagttgcagaaaataatatcactatcatgcttttttaaaggattaaataagatatatttaaaaatttgttatccttatacctggcatagagtaagcgaacagtaaatggtatatttgtaattattcttttttacgttgctttctacttaatatgcgtttattaagcttcaccttaagtataatttagcaaaggattatttcagttttcccttaaaccagtttataagtttacatagggaggttaaagccaacaggaatttttatgtaataaggaaattcaaatatttcagtatctgtgataagagttgtgttaatttgcagaggaataacacaaaacattgattaaatttggattgctaaatgttaaacagtgtttgtacaataaaagtgtgattcagaaaaagccttattataacatgcggaatgtattagcactctttggagacttactatcttttaatttattttattaagctgctgttgtgagctaactaataacataagtgtgaactagtttgaagaagaattgcgattttattgaataatattctgcaagaattaaatatcaataggttagcaatatctcctcattgagttaaagtatatagattgtatacatgttctatgtatatactatatataaatgtttagatagtatatatgaatggcataattactataagcttacagggaaatatgcagagttgctgttatttttagaaagtaaatgatgacatttattttttatctaaaactttaatctgttcagtgatttagattcatttgagctctaatgatttggagagtaaggcacaggcatagccttaatttattggtgatgaaaaaaatctacttattggcaagatgggggaaaaaatcacaagccttgtatggaattgtatgattctgcagagttgcaatggtgttaacaattgtgacaagttacactttctgagacaatcttcaattttagcaattaaaatagcaaagaattattatttataacagtattcataacatagcaaatggtcatattccttatagagacagcacttccgagtagtctttattttgtttttcaaatttgtcctttcaatatctcaaaatatcttgtgttgcaattacatttccaagtatatatttggttgggatgaaaatagctgtaatagtagtagtagctaccatttattgaattcttgccacgtgcctcatattttatgtggtgtatttgatcttaggccttaggacaactgtaaaaggcaggtattgtagaagacaatgttttctgagagactgaaatgacaaattagaaaaaaagttaaagacttcttggaaatgctatctctataaggaatatgaccatttgctatgttaatactgttatgaataataattatttgctattgtaattgctaaaactgaagagtgtctcagaaagtataatttatttgtcacaattgcaactctgcagaatcacccaattccatacaagacttgtgattttttcccctaacttgccaataagtattattaccataataaatatgctgacgtttcaaagtttaagaaacttcctacagttctcacacgtagtggtgacaatatggctaaggggttaggaatgcccacatcctcctatgctgcatcctgcctgtggtttagatttgagatagggacccctactttctttcccctaagagcagatctgtgtcattggctataactgctttctggtcagccacatgacacgtggacttaacagatggtttctaataagattgaaagcatatcttgactccacttacctggccagcactggagaaaggaagattaagagagatttggatgagtgtccttgtcacataacttcccctccctagaaaacttggtccaatacgttgtaatctggtggtgcaaactcacaacttttcttcccttctgtgagtgtgtatatatgtgagtttattgtatgtgtgtgtaaggtgtgaatgtgtatgtgaagtctgtgtgtgatgtgtgtatatttgaatgtcctgtgcatgagtttttttgtgactgaagtgtgtgtgaggtgtctgtatgtgggatgtgtgtgtctgtgaggtgattgtgtatgaggaatgtacatctgtgtctgtggtatatagaaaacgtgtgtgtggtgtatgcacttgctgtgtctgcatatgcatgaattgagtatgtgacttgagtattgtgtgtgtaggaggaggggggaagtaaaaaggcaaggtgacagtagagactggacaaatgaacatagccgggcactattcctttaactcctagaacagacataacttgaagtgatctagacttgaactttggagtatgaagttccagccagctgtgtaactatctatttaatatttggaagcgcttagcctgcttaaatcttgattttatcatttctattagagaagttttaacttaaatgctctaaggtgggggtgtccaagggagaaaatacagtcatgggttcttagtttctgtttctggttgggccagaaaagctccttcctcatccctcttttccacttatcaacagagacagaagctaaaaaccatggcttctggctgctaaagcctaaaataaaacaaaacagaacaaactcatcaacaataacagcaaaataaagcaggttggaaatgactgctctaagggtgaagtgaatatgttcaggttggagttactgataagttgtaaacaattacaaggatgtaaaatattgcatatttttattagtggcattacttttccaacattacattttatattgaagttccagaacaacaaaaaaacactaaaggtattgcagtgaggaacttatcagtaagtgcttctaccttcaaggaattaagttaatttttattggcaatatttggaacattgtatcaagaagaaagactagctaacgaatctcttttgcacatcaagctcttacagtgttaattcattaaacaactaagacaattttaagtaggagctttggtctaagatgtgtggccgcaaactgaaccaatactgacagaatttggcattaatttttttttcagagaattttttttttaatatatggcaatggttgaaaaaaaacatagaatattgtagttcctcaaattgttaaacacagagttatatgatccagcaattctacttctaggtatatacccaaaagaattgaaaatacatagacaaatgttcacagcaacattattcttaatagccaaaaagtggaaacaatccaaatagccatcagctgatggataaacaaatgtggtatattcatacaatggaatattattcaacaataaagaattcagtatcaatgcatgctattacatgtataaaccttgaaaacattatgctaaatgaaagaagccggaatgacataatttcatgattccatttaagtgaaatgtccactatagacaagtctatagtggattaatgattgcctagggttggagggggtatggggaattgaagattgagggtcaaagggtttggggggtgtactgaaaatattctaaattgtgttaatggaggcacaactctgtgaatgcactaatgtcactgaattgtacattttaaacaggcagattgtgtggtatttcagttgcatctctataaaggtgttaaaactaaatatagaacaattttcctaagtagtggcccctcctcatttattggaccaatagtttgggaggaaccagtcatgaccttcctgatacaaatcaacacctacagataggatgggaggcaattgtgctaacaaagtacctcaaaccacaaagtctgtcagtaaactgatgcttttgtcaaggatgaatgaccaggggcaggtaataggtgagcaactctcaactcttttgtatatggtactatagtctggaactagcaagtactgaaaaacgctagatgataaaagtcattgttattttattcttccctctcccttcctcccctcccctgtgctccctttcctcttcccattttatttatttatttgagacttggtctggctctgttgcccaagctgagttcagtagcagtatctcagctcactgcaacctccgcctcatgggcttaagccattctcacacctcagcctccagagtagctgggaatacaagtgcatggcaccatgcctggctaatttttacatattttgtagagacggtgttccaccaggttgtgcaggctgggcttgaactcctgggcttaagggatctgcaggcctcaccctcccaaagtgctaggattataggggtgagccaccacacctggcctcccctccctttttcccctcccctcccacccttctcctctccccttctctctcttcccttcttcttctttcccccttttcctcttccttcttccctcctgtctttccctttccactcttttctccttccccactcataaatagatattataatgaattaatttagaattatagttaagcatacatttgaagtaattgttccaatttcataattttgaagtattttctgagaataaactgggcaaatgcagaattgggacaaatcctatgtgcaataattgctaataggaagtgttctgaagtatgaattctctcctcctttcttgtttgacttgtcactgaatctccagtcctacagagtactatgtcctgcttattgtttatttataccacaccccacttctacgtataaacatcactttcactacggtggattcaaatgatctcttaggaatttagttacattacagtctcacataaaattactgcccttaaaaacatttgtttgctgggcagggagtggcgaaaccccatctctactaaaaatacaaaaattagccaggcgtggtggcgggcgcctgtagtcccagctactctggaggctaaggcataattgctttaacctgggaggtgcagcttgcagtgagcagagattgtgccactgcactccagccttggcaacagagtgaaactctgtctaaaaaaaaaaaaaaaaatttttttttttgctaacattatttgaagaatagtcagttcagtatgcatctatgtagacctaaccaatagttgtattttacaagtttcagttttgaaatgttggatgatatctttcagtttaaaaaattagtatttctataaagtgtctttttttggatggaaatgtttctggaatgtgacacttaaattttaattactattattaaatatcaatggatttgttttgcataaccaaacagttggataagttcagtttatgtgctgtgcaatactaagatatttacttggcatggagagaatcactggcttactaaataaaagaattcagcattttgtttgtcaatcctatgttaattgcatttatatttctgacagtttccttgatggaattaaaaaaaaaaaacatgcaataagatctgaattgagtgttgaaatgagtgtttcctgagctccaattagtgaaagtattgagatttgaagaatggttgaggagacaaggttttataattgcccttctgggaaaaagaatgagtaaacaataaagtcttgagatctctcaaacaaatatacagtcataaggaaagtttaaaagccacagtgaaatgcacacctcttaattatgttaacattgatatctattttaaattgatatcaatattagctgtgaaagtttcgtatattttgcagggacaaattctcttagtgtactccaaatgcttattgttacacatcctgagcacacaacgcaaacatattgggcaagcaaagaatctaggctgatatgtgtgaatgcttatgtggcattctatcaaaggagatagatgtacataaggggaattatggagaagtgaaaatttgtctaaggttcattttttcagtagcttaattttaatagtaaactcttttaaggaatgaatggccacaggcagagactaatggtgtactttcagtgttctcagtgagtgcttcacagattaggtttccaagagaagaagattgcctctgaggaagaagagatggggtagcaagaggcatatatgagaccgttcttgggaccaacacctatggaggggagggaagaaggcagaattatgggaccagatagaagaagttggtctgcaatgcagtcttgaggaaggcctcagcagagccaatagacagttccgaagctggcatgcccttgagagttgtcctaaattcgggtgagagggttaggcctttatatccttggtcacttgatagtagatgctggaacaaaatggtgctctttagctaaggcaatttacagagggctgacagctgagagcacttgtagaatctaggaaaatgagtctttcattcttgaaggggaatcttcacatcatccactacaaatggtgctatattttggaaccagcagacactgagaaatgccaggtggatagaatccttccttcttttattctatctttttttctttctttctgtctcctaatctagtgcttctccaaaaatacttttaagaattagaattaggccattagttattataaggaaggaagggaaataatcattttcataaaactcagcaattcttttaatgtcaagatatggattattattacactcaacaattataattattaatattttccacggaaaagtttcatatattgaatgacccaagtactccatgtgaccttccctgtctatgtaagcctagcattctgtcagccaaataaaattttggaaggaaggtcagataaaattattttttcactcggtgttaaagaaaagaaaaaataaagaacatttattgagcatgcactaaatatgacataaaagatctttgttttctgtattagaggttgagaaagaatgaaacagtctattgatttgaaaagctttgctctcatttagcaattattattattattattattattattattattattattattattattgttgagacagagtctcactctgttgcccaggctggagtgcagtggcgcgatctcggctcactgcaagctccgcctcctgggttcacgccattctcctgcctcagcctcccgagtagctgggactacaggctcctgccaccacgccaggctaatttttttgtatttttagtagagatggggtttcactatgttggccaggatggtctcgatctcctgacctcgtgatccgcccacctcggcctcccaaagtgctgagattacaggcgtgagccaccgcgcccggccaacaattatttttataaaataaaagtttattaatgaatttatacaaatagcactttataaaaactacaacacattcatttgggctgggctgttgcctggttagtcacattttttcttctttatttagctattgcacagcttctgaggcaaccacaaaaacatcaaattatggagaagtgagtgcatagatatatgaaatcaacatttcaaattggtaatagaatgaccttacttattaagtagtgatcttttatcaagctgctacaataaaatcgaccataacattaaacatggtagatgttactaaccagaaatcttaggtatttaaagttatgtttacttattttttttaataagacttggaagtgtcacttaaatcacacttaagaatggatattggctaaaggctgctgagtcttttaagattcctgtgaatttttttcagattgttcctcagtcaattcaggatacttgtcattgctggctatacagcagagtgcagagttagcccttgcagacacacaaagataactcaaggcactgatttctgcatcttcagcctcctcatttcattaactattaaaattaattccctgtagagataatttgcatcaatcaacagaatagaagaattagaagagcttctgaggcttttctatgactaaaagagcaattcttttattgactaccataaacattagatttactaaaaggaaaaggtgttttaaattgaaccacccctctaatttattcatcttagttctgaaaacatgtaggtaagagttaatcatgttactgaatctaatttaaaaagtgagagggaaagtactgaatatttttcctctttgaaattacatgttgtttgcaatattagcctgcctgtatttttcatgtaaaccttttgtacattgaaaacaaattcaaaataaagaacgtttgttttcaggctcagaccttaagaactgatggtcttttcttttacttctacacaaaagtctaagcagttctgaagaaacactacagtgacattgggtcattgctaaaaaaaaaaaaaaaaaaaaaaaaaaaggttcacaaactatcaacattttaacaatctaatagttgattgttgtttcccaaattggtgattttgaatgattattttatgtagaatggaactgtgtctttttcttcattcatgcaacaaacatttcctgatggataccaagcaacggtgacaggtaagcatgccatcctagatcagtgttatataactcccaagcttcagtgaaggcctcatttttgttattacaaactgcctctctgggacctcatgaaggtactattcctgtttcgggaataggtctatccatccttgtctttttgtttcctgtcttgattctacaatctcccctttggccattaccatctcaaaatcctgcttcccaaggtaatccgtctagcttttctaatcttctggcttcccattactcatttcaattccttcttctggctccctgttgctttcctaaccaatttcaattacttatccttatcttgaaggccattcaccactctgccctgctgacgtgtttttcttatcacccaagattcctcccccggctcacacttctgcatgcaagcacgttcccaaagtatgaaaatgctttggatttatatcatgctgttgccttgaagagttttattctcttcctcatatcttctcagagaagaaagtaatttggctgtggttcaaaattcaccaaggcagtaaaatcttgtgttttgtacacaacttcctttctaatgacctctccctttcttcacctcacattgggcattcactcataactatttaagggccttctcttaggcggctgccctgttttcaggttgtgccctatgtggtcacaagtggctattcttaataaatcatagaatcgtagaatttaagtactgacagggatttcctatatataagaatccaacttcctactctgcagaaatccatctcagaacattctcaatgcttaaaattgccttttcgggagagaacatcaactcgtaagacaagctctttccttgttgcctaggactcatttttagaaaaatattctttgtaatgaattgtttccctgccacttcctccctttggtatgaggcatgttgccagaaagatacaaaataattctaataatctttcttagccttgataatgcaagagaatacagcaataatttcctccattaaaccttatttttttttttttttgaggttagatgcctaaattacttcaaggattcttcttgtggaagcatttttgagaattttcttgtctttctgcacctctgatttggtaacttgaccagcagacttcacaagaagcttgctgtcagtgttagtccaaacacaacctatcagttagtgtgtttagtcattaatatttaagagtgttttcataacctttaaattaataattagtcatctttattctttaatgactacagaagctcacattcatagtattttggtaactaaggtatccataggctcaaaaactcttcaaaattattgtgtaatgaaaatgttaaccatatttaagagagtgacttggaaaaaggccttgtttttcaatctcatattttgaagaactattgagatgtcactgaatagtatttttagaatttttgaattgctcacacatgagcacttggggaattggtcagtgaatatatctcctgagcactttgttccttgaaattatcaaatccttcttggaatttctttttctctctctcgtgatgtgtgggtgggactgggacattaccaacacaattagaacttcatttctttttcttcttagtgaaatttattttctaaaaggtttgtgtgtttcactctattagcagttctggaatcatccaagagtctaagtagatgtagcagagctcttatggaaactctggatatatacataatcacacagagaatttgtatttaattttagagttacatgtaccactggaatcacattcatatttctattacagtgtagtgattctgggttaagaatcactgatttagttctacctcattttacatataccttttcctgcaaagatatataaaaataaaatcatatgaataagttatgtgtttaatagttccattcagtcatctcataagacaaaattactttctaagttaattttaattcagatctttatagaatattgaggttttaaatgtgaacacatatatataattttatgatacaaccttttcttctgaatacttaaagtgttttcacagttggaagtatcaaaaactttgttctctgtaaaccttcagcttccatccttcttcagtcttatctgcagttatctcctgcacatgtaaatgatgtggtagaagatacggtttaagatgaattttagttatttaaagtgtgtcataacctgaacattttacagatatatttaaacaggtataggtatatttaaaatcactattttaattaaaaaaaaaaaaactttgaaaaatccctaatttcaaaaatatatttaaaatgtacatatatgaataatatatagagaaagataggaaatattaccatgaattatacagacctcagtttatctaaatttacagttttaaaataataatcttatccttattatctgaagatgtcattgatgatatgtttcatttttatatttggctttagtttaccaatattaacatataaattattaaacaattgtacaccagctttgtggtctctcctttgtcatgtgtgatttgtgtaatttgatgaacttgatgaaagcttccatttcaacttgaaggctgtgaatatgccagattatgtgcattttgtagtaaggattatggagctgaacaagtatgacagacttgttaaatatgttgtctacaaatttttttttgtttttgtttgagatagagtctctctctgtcacccaggctggagtgcagtggcgtgatctcggctcactgcaacctccacctcccgggttcaagcgattctcctgcctcagcctctcgagtagctgggactacaggctcgtgccaccatgatcagctaattttttgtagttttagtagagacagggtttcaccatgttagccaggatggtctcgatctcctgacctcatgatccgcctgccttggcctcccaaagtgctggaattacaggtgtgagctaccgcacccggcctattgtctacaaattttatcacttttggtaagaaatgcacaaagcctatcatgatgtcattgctagtttatatgtttgtgaattttaagccaaacaagcgttcaaaacgtttgccacaaatcgaggacctaaaacccagttttatatataaagatatttaaaaacatatttctggagaactatgcatatactaccaacacttacaaggcaaattaaattaaaaatgttgtataaggaatataatattttaaatttttagtgtaatcaagaaaaagatacattgttttatcaattgattaatttattggtcataggatttggcctatttatatttctgagtatccaacagaatcagtcccttaaaatgctgaatatcacaatttgcagttcggctaatacatttatatccattttattacttagttgtaatataaaggaagttacctcttcatatcccagggaaactatggtagttgacaaggagtgggtccaggctttataccaactgatgtcttatacaactcgaggagtcccttttaagagaaatggatacatcattggaatatgtattgaatgtggagattgaatatttatttaggatgtaaaactaaatcacaccagattataaaattaataaagctgacaaattctacaaggataacaaaatttataaaattaacttcattttcagaaaattaattgcttgatacatttctatgatttttttggctctgtagttttggttgcttattctctgattgcctcttcattttacatgattctattatgttttctatgttgagaataacaagataatgcagtcttttctctagtataattgattgtaatctgtcattttattaccgatagtttagaaaagttacatcaagtttctcaatttttgggggtgatttcatatacattcttaggactgtgaccaaacttgggaaatatctctatcaaatgtctttcatttgtgaactgtaagatttggaagaattttcaaagagcagttcctggctttatatgttttgaacattgtgtctccttcactccacacagacttgtggtgcctgaagctctgggcacattgattttggagtgatctctgggcttgcactttcatgttaccagcaccatggtaatcaggtgtgttcgtggaagctacacccagacagccagcaagaacctaagggtacagggaagagactgagaaccacaagaatataatcacaccaaactgaaactaaatgaatctttaactcagtttctaattagccagatcccaaaatggcccacagtcaccccagtgctaactaacccaagggaaaagtgtgatataggcaaaatcagtacgtagacattgatcttaaacttctgcagttaaaatgtctcactcatgcaaaattctaaaagcaaaggagcatgccatcccacccctcgagccttttccagtgccttaggaaggagcttgtgcaagtgaggggccctgaagcttcacccttcctagcctcacggtaaatccacctctgtggtagacagaaacatttctagaccacaggaaatctgtttgcctaaggaaacacagaagctgtccttacagttaaacagaaatagttctatttttttcctagagttcagcaccatttctcaaggggtatttcttagaagttcattttatgaagtctcctccacaagttctttttgatagccaataattcaaatgtcatgctacttctttaaatcactccagtcattgaatagcataatcttttcagggggcaaacagctgggctccagtaggctttaaatgttcatttgttttccaattttttgacttgcataggaagaagtaatccctttcatgtgaaatattcccctcgattaattttaaagaaccaatggcattgtctgataatgggatgaaagcccaattcactgaacagaatgtgctatttgtaacctggattatcctttaggtttttcggcatagtcctcgagaagctgagaatctgtcattttattgattaaaatacacgtacagatacacacgtttacattagaaataaaaatgttgtaagctcaaataggcagggtatttcacctgaaagcctgaaataaatgtgatgagaacctatgaactaagttccagtgtaaacaagtgggttaaattctcattatagaaacttccagtgagcaatgcagcatgactgtgggaccataattcaggaacaatctgcagagcaaaatatagaggcactaattttgttatatttgcagcccacatactgtaataccagatttgctcctgttgttctggccaaagatgagtcaggtacctctgatataaccattcctaaaagacaacaatggattcagaatgtgagactgagagaaatcctagaagtctgaccttcagatcagtttaactgtagatcaataatccattactcagaccaacacagtaccaaaaaatctcttcagctggctgccaaggtactattttatcttaaataagctggttgagagcagtcaatatagatacatttttcccactgacaatttgctgattcagagaacatgcaacatccagccacgaaatagataaagctcaggcctgccctgtagaatatggtcacctggctttcctgttctcctacaaatgtcctactggaagaatagcccttaatcccttaatgttcatctaaaccaaggcttgttctaaattctctagactctatctcatgcattattacatctctcttggcatacttctcttcttgaagtgcataacatttatataccttctacaaatgttggtattattgatattgagggagggggcagacccaggtctatggccttatgtattattagtgaattacaatttcttagagtaataggccaatgattaaagtcacatgttaggaaaactttaatccactagggaaaacttccaatatttttcaaagtaatttactacatttggatgcaaattatataggtgtttttggtggtatccatacttgctttcttgtcaacctgaagagatgtaaatgtaaatcgatgctaattgtaccgtgcttacacaaagagctaatttgagtaatatcctatcccatcagttcattttcaccatacatttttttctttacaaaattgtttttaaaactccactggaaaaaaatatataataaactacatgtaaattacacaatttagtaaattttgatataggtatacacatctgtgagaaaattaccaaaactgagatagtacacaaatatatatcacccccaaaagtttcctcgtgtctttgtcattccttcctccagctttttcccagaaatttcaccttcctcaggctgatcaacactcagctgaagactcaagagggggcctgtgcagatgtccctgagttccctctctgggccactgtctcctctcttttcagcaaattctagttaccttgacctccctgaattcccagctccatctcctcaacttagggagactttcaggtcaggcagtgatccctcctccttatgctgggacctggaagctctccagcatgtacactggggcaaccataggcgtcatctcattgtattcattttctctaatcaccatgctaagctaactgttgcctaaggtctgaaaactgttgtttcattcattttgtccagtttttccattctttcatgagcaagcataaacctgactcctttgggcaagaagcagaagtccctatagtgactttatttactttattgttattgtcagcatttggaaaaaaaaatgtagagattgactattttatactatttaagtaattttttgttatattgattttacctaaacaagagtttattagaagtattttgttatacagcttataacaaataattgtacaaaaattagaaaaatcagatgaacaaattttttataagacttctcgtggttatagaatgactctaacaccttgtagtgtattttttaggattttgttcttagtgcatgtgttagtctgttttcatgctgctgataaagacatacctgagactgggaagaaaaagaggtttaattggatttacagttccacatggccggggaggcctcagaatcatggtgggaggtgaaagacacttcttacatggtggcggcaagaaaaaatgaggaagatgcaaaagtggaaacccctgataaaaccatcagatcttgtgagacttattcaccaccacgagaatagtataggggaaacttcccccatgattcaaattatctcccaccgggtgtcccccacaacacatggaaattatgggagtataattcaagatgagatttgggtggggacacagagtcaaaccgtatcagtgtatatgtttagagggacatagaaaactatataagtttaataagaatatatacatattgttattaaatgaaaacatttgaaattataaaagtagtaaatattttttagtaaaattaaatatatatatagtaaaaagtgaaagctgttttacttccattcccagagaaaactttacttaaattttatatagttttttccagagttcttcctacacctgaaaaacacagtggattatttttgtgtacaaaagaaaagaaatcattctatatgtatctcctttacttccactctttttctttccacttaattcatacagataaactttaccatttaaatggcctctggtgattcctttataagaatgaaccattagatagttaaccagtttactaatgacagacatttatattgctcccaagttgttgccattgttcatttatttatttctttagtattaattcctagataagttgctacatcaaaaataatgtacatttaatattgcaatagttacaaggaaatctgtacttttttcagtaatatattagtgtctactttcaaaaagctttaaattctgagcatcatattgtcttctaaatctttgacaaaaattaatgtaaatgaatatgctattttaattgtcatttatttatttgattattagtaagatttagatttagatttcagtctttttattagccatttcagagggatgagcattctctgcctatggactttgcctggttttgtattgatgtgttcattgttttcttatttcctcatttgtaacatcattttaaagtgcttttatttctggacaatgtttttacattttttaagactcctattgtgatttttattaaaacaaagttagatctatagaaaagctggaaagaatttgaagttttaacgatattcgctctccctttccagaatatgtggcaaaggagggaaaagaagggattctgaaggaacacacgggaagtcggcagtgtgggagtgatggatatgttcattcccttgcttgtggtgatggtctcactggtgtatacatttgcagtaattgtcaagttgtacactttaaaatatgtgcagtttattttatctcagttacatctcaatgaaactttttttttaagtggcaccaaacatacattaaatagctttcagccaaaagtaaaaactgagtttggtcagaatatttttgtgctattttggttagatttcttctgtcacagttataatggctttctaaaataaactaggaagccggagaaagtcactttaaccttcaagagtagggaaactgaacccataaaaaaagtgcttccaggtcagactcagcctaaaaaacctgaaaaataaatgtgacttctgagtagcagtatatgggaaaaattttctataaatctctgagaatgaagttgactggagactacacaagagacaaagagatatagaattgccttaaatctgaaccatggagttacagaatgataatggcattatgataaatttttagagaacactcttgataaacaggcacactcaaaaatagctttttgtttgttgttgttgttgtttgttttctgtgcaagaggtgacaattgaatgaggttccaaaaagtagtgtgggcttgcattgcacacatattatcaggcaggatttgtgcagtagagaaaggtgactgaagaatgtagtggaaggacatgctactggaagaagctgccaagtgacatacacagggctgtgagtcagccagggttgaggctctgtccagtgggacagcaggctctgtctccacagtggggactgcctgagagctgggtgctctggttcagccattgtagcacaaaggcacttgtataaatttccgtgaaatggcttgaaacctactttgccataagaatgagataaatttttaattcaaaacttaaaatatcttgattagaataaggaggaggaagagaaagaacaggcaataaaaagttatttattgattgattgacttaatgcagctagctgaagggtgagaggaagaactccggctccagagtctgaaagccagggctcaagtttcaatttgggcatttcccagctttgaacaacagaaaaacactgtttaccttttcagaacctcagtttccttagatctgtaaattagcaataaaaactaatgtgccttccaaggttatggtaaaaatcaaatatcttatgcctgtgtaaatctttttcaaaaaacaatagacactgcaaatattgggcattcttatgatgatgtttattcttcactgggagcattgatggattgattgttacttttcaataactttttccatatttgctctagttttaaatttgcaaattttaattcagtattgtttataataagacaaaagctcttctttaaggttggggcattaatgttaaaaaaaaaaaaagaactgttacatcaaatgtacatcaaatgcagtgactggacaacaaccaaagaaacttcctgtgtaatccccatcccatcacacacacacacacacacacacacacacacacacacacacacactatagacactatatttaaaattggcaggggtgatattatgaactcctgtaaaaccaaattgatttgtgtttgtcaggaatgtgtgggtctgtgtcctggaatgctatatatttccactgtgcactgcccattgaccatttctactaggatgccttgaaggcacctcagactcaacaagttcaatttgaaattcattatgtactccccagttgttcacgctaggagccttcaggccacccgtgacttttctctctccttgagtctctccttagcttcccatggatcagtctctgtaccatgttgattctaccttctgagtatcctttctgctctccctcatctgcacttctgttaccactgcctgagttttggttatgggcttcttagtcttttagtcttttctctcccccaacccagccatcgccaccagcaagaactatctttctaaagcaccaattatctttccaaaacagaagattttctcttctttgtaggaatttaactttagggcatagtcagataaattagccaaaatatatgtgaagaagctgttcatcacaatattgtttattatagtaaaaaaaggaaaaaaaccttaatatctcaaaaatggatcagtaatatcgagactatacacaatagtcattacattggtattatagatgtataataatttggaaatgatattataaaaaattattaaataatgtgcatagaaaaatttgtggaaaatgttttatgctataaaaatatttctaggtaatggaatttagtaagaatttttctcttcctacttcccaccaaacaaaagcaaaataaaactaaaatagaacaaaaattctgctatgtagccctttacaaaagatagtgcttctggcaagaaactgtgactgaccaaaatcctgcaattcagtacctgtgaaatgccatataacaaatttactcatatcctaaaagttatgagaactgggggcttcaggacatctcatacctgcctcattttttcaagaaaatttgttgtagaatcttttatataaaacactatacactgtccttaatccactatgtcctattccctctatttacaaatgtgctttgtccttacatttctttaaaaaaaaaacaacaaaaaactgtgttcacacgtatctttgtaggctaaagaaaagtgatactataaggattgggaggtagagggtgggggcactgaggaagccctgctgccctcaggttaagctccgtatctctctcatttaaggtccctgataggagttacttgttctcaaacatgtgtgttggctctttactgtcttttaagtagcatttatgatgaattccctttttttaatggtggtattacagtatctgatgttaggcatagaactgctcaggcagcaagtcaccttttctttttccccttttttgatagacttgagagaccaaggcagcacacacacactcctccaactagctttgcaatttgcatacatttcgattctggtggtctattcatcatttttatagaaatgcttttatgaaattcgatctcatggagtgagttaggagtttctttgttttttgctttatgataacccattgcctcagtaaatatcttaattattcccagaaaaaaataaacccaactgattagacctaatcccttctcaaatcactttactttctttgtcatttcctatccatcctctctctacactcagatgtctttgttttattatgaaatatatttggcatgagtaacaacattaagtaatatgaatcattttatttggttaaatgtctacactcaaagattagtggagaatttggaaaatataacgaaataatactggaacttttgatatttccctagctacttgccatattcaaaagatgtgtctttgaagtgaagagcagaatagtaccttattatagtccatattaaatcatatttatggctttcaacagaagtattgaaaaccagattcagttgctgcacccatcaactcatcatctacattaggtatttctccgaatgttatcccttcccttgcccccaaccccccgacaggccccagtgtgtgatgttcccctccctttgcccatatgttctcattgttcaactcccacttatgagtgagaacatgcggtgtttggttttcggttcctgtgttagtttgctaagaatgatggtttcaagcttcatccaagtccctgcaaaggacatgaactcatttttttttttttatgtctgcaaagtattccatggtgtatatgtgccacattttcttcatccagtctatcattgatgggtatttttgttggttccaagtctttgctattgtgaatagtcctgcaataaacatacacgtgcatgtgtctctatagtagaatgatttataatcctttgggattatatacccagtaatgggattgctgggtcaaatggtatttctacttctagatccttgagaaatcgccacactgtcttccacgatggttgaaccaatttacactcccaccaacagtgtaaaagcattcctatttctccacatcctttccagcatctattttttcctgactttttaatgatcgtcattctaactggtgtgagatggtatctcattgtagttttgatttgcatttctctaatgaccagtgatgatgagcttttttcatatgcttgttcatatgcataaatgtcttcttttgagaattgtctgtccatatccttcgtctgctttttgatggggttgtttgtttcttgtaaatttgtttaagttccttgtagattctggatattagacctttgtcagatggagactgcaaaacttttctctcattctctagcctgttcactctgatgatagtttcttttgctgtgcagaagctctttagtttagttagatcccatttgtcaattttggctttcgttgccattgcttttggtgttttagtcatgaactctttgcccatgcttatgtcctgaatggtattgcctaggttttcttctagggtttttatggttttaggtcttaagtttaagtctttaatccatcttgagttaatttttgtataaggtgtaaggaaggggtccagtttcagttttctgcatatggctagccagttttcccaacagcatttattaaatagggaatccattccccattgcttgtttttgtcaggtttgtcaaagatcagatggttgtagatgtgtggtgttgtttctgaggcctctgttctgttccattggtctatatacctgttttggtaccagtagcatgctgttgtggttactgtagccttatagtatagtttgaagtcaggtagcttgatgcttccagctttgttttttgtttgtttgtttgttttttcttttgcttaggattgtcttggcaatacgggctctcttttggttccatatgaaatttaaagtagttttttctaattctgtgaagaaagtcaatggtagcttgatgggaatagcattgaatctataaattactttggacagtgtggccattttcactatattgattcttcctatccatgagcatggaatgtttttccatttgtttgtgtcttctcttatttccttgggcagtggtttgtagttcaacttgaagaggtccttcacatcccttgtaagttgtattcgtaggtattttcttctttttgttgcaattgtgaatgggagtttgctcatgatttggctgtttgtctattatttgtgtataggaatgattgtgatttttgtacattgagtttttatcctgagactttgctgaagttgcttatcagcttaaggagtttttgggctgagacgatggggttttctaaatatacagtcatgtcatccgcaaagagagataatttaacatcctctcttcctatttgaatatattttatttctttctcttgcctgattgccctggccagaacttccaatactgtgttgaacaggagtggtgaaagagggcatccttgtcttgtgccagttttcaaagggaatacttccagcttttgcccattcagtatgttgttggctgtgggtttgtcataaatagctcttattatttcaagacatgttacatcaatacctattgagtgtttttagcatgaaggagtgttgaattttatcgaaggccttttctgcatctattgagttgatcatgtggtttttgtcattggtttcatttatgtgatgggttatgtttattgatttgcatatgttgaactagccttgcatcccagggatgaagccgacttgatcgtggtggataagctttttaatgcgttgctggatttggtttaccagtattttattgaggattttcacatcgatgttcatcaaggatatttggcctgagattttctttttttgttgtgtctctgccagcttttggtatcaggatgatgctggcctcataaaacgagttagggaggagtccctctttttctattgattggaatagtttcagaaggaacggtaccagctcctctttgtacctctggtagaatttggctgtgaattcatctggtcctgggctttttttggttggtaagttattaattactgcctcaatttcagaatttgttattggtctattcagggattccacttctttctggtttagtcttaggaaggtgtatgtgtccaggaatttatccatttcttctagattttctagtttatttgtgtagaggtgtttatagtattctctggtggtagtttgtatttctgtgggatcaatgatgatatcccctttatcattttttatttattgtgtctatttgattcttctctcttttcttcttcattgatctggctagtggtctgttttgttaatcgtttcaaaaaaccagctcctggattcattgattttttcaaagggttttttctgtctctgtctccttcaattctgctctgatcttagttatttcttgccttctgctggcttttgaatgtgtttgcccttgcttctctagttcttttaattgtgatgttagggtgtcaattttagatctttcctgctttctcttgtgtgcatttagtgctataaatttccctctaaacactgctttagctgtgtcccagagattctggtacattgtatgtttgttcttattagtttcaaagaacttatttatttctgcctttgtttcgttattcacccagtagtcattcaggagcaggttttttgattttccatgtagttgtgctgttttgagttagttcttaatcctgagttctaacttgattgcactgtggtctgagagactgtttgttatgatttctggttttttgcatttgctgaggagtgttttatttccaattatgtggtcaattttagaataagtgcaatgtggtgctgagaagaatgtatattctgttgatttgtggtggagagttctgtagatgtctattaggtccacttggtccagagcttagttcaagtcttgaatattcttgttaattttctgtctcgttcatctgtctgatattgacagtggggtgttaaagtctcccactagtattgtgtggaagtctaagtctctttgtaggtctctaggaacttgcattatgaatctgggtgctcttgtattgggtgcatatatatttcaggtagttagctcttcttgttgcattgaaccctttaccaatatgtaatgcccttctttgtctttttctgtcttttttggtttaaagtctgttttatcagagactaggattacaacaccttttttttttctttctgtttgtttggtaaatcttcctccatccctttatttttgagcctgtgtgtgtgtttgcacatgagatgagtctactaaatacagcacattgatgggtcttgactctgtctagtttgccagcctgtgccatttaattggggcatttagctcatttacatttaaggttaatattgttatgtatgaatttgatcctgtcattatgatgctagctgtttattttgcccattagttgatgtagtttcttcatagtgtcagcggtctttacaatttaatatgtttttgcagtggctggtatcagtttttcctttccatatttagtgcttcctccaggagctcttgtaaggcaggcctggtggggacgaaatccctcaggatttgcttgtttgtaaaggattttgtttcttcttcaattatgaagcttagtttggctggatatgaaattctgggttgcaaattcttctctttaagaatgttgaatattggcccccactctcttctggcttgtagggtttctgcagagagatcagctgttagtctgatgggcttccctttgtgggtaacccaacctttctctctggctgcccttcacatgttttccttcatttcaaccttgatgaatctcacgattatgtgtcttggggttgctcttctcaaggagtatctttgtgaggttctctgtattttctgaatttgaatgttggcctgtcttgctaggttggggaagttctcctggaaaatatcctgaaaagtgttttccaacttggtttcattcttcccatctctttcaggtacactaatcacatgtaggtttggctttttacatagtcccatatttcttggaagcttttttcattccttttcattctttttttatctaatcttgtcttcatgctttatttcattaagttgatcttcaatctctgatatcctttcttccacttgatcagtttggctattgatactgtggtaagcttcacgatgttctcgtgctgtgttttttcaactccatcaggttatttatgttcttctctaaactggttattctagttagctattccactaaccttttatcaatgttcttagcttccttgcattaggttagaacatacttttttagcttggaggagtttgttattacccaccttctgaagcctatttctgtgaattgatctaactcattttctgtccagttttgttcccttgctggcgaggagttgtgatccttcggagaagaagaggcattctgttttttggaatttccatcctttttgcactggtttttcctcatcttcatggatttatctacctttgttctttgctgttggtgacctttagatggagtttttgtgtggtcatcttttttgttgatgttgatgctattgctttttgtttgttagttttccttctagcagtcagacccctcttctgcaggtttgctggaggtccactccacaccctgtttgcctgggtatcactagcagagcctgcagaacagcaaaaattgctccctgctccttcctctggaagcttcgtccaagaggggcacccaacagatgccagccagaactctcctgtatgaagtgtctgtcaacccctgctgggagtatctccctatcgggaggcacaggggtcaggggccaacttgaggagggagtctgttccttagcagagcttaagggctgtgctgggaaatctgctgttctcttcagagctggcaggcaggaacatttaagtctgctgaagctgtgcccaaagccacccctccccccaggtgctctgtcccagggagatgggagttttatctgtaagcccctgactggggctgctacctttctttcagagataccctgctcagacaggaagaatctagagaggcagtctggctacagcaactttgtggagctgcggtgggctctgcccagtttgaacttcctggcagctttgtttacactgtgagggaaaaaccacctacttaagcctcagtaatggcggacacccctccccacaccaagctagagcatcccaggtcgacttcaggctgctatactggcagcaagaatttcaagccagtgtatcttagcttgctgggctctgtcagtgtgggattcactgagcaagaccccttggctccctggcttcagcccccttccaggggattgaatggctgtctcactggtgttccaggtgccattgggttatgaaaaaaaaactgcagctagctcaatgcctgcccaaacagccacccagttttgtgcttgaaacccagagcccttgtggtataggcacccaagagaatctcctgatctgtggctagtgaagaccgtgggaaaagcatagtatctgggctgggtagcttcgttcctcacggcacagtccctcatgacttcccttgggtagaggagggagttcccgagccccttgtgcttcccaggtggggagacgccccaccctgcttctgcttgccctctgtgggctgcacccactgtctaaccaggtccagtgagatgagctgggtacctcagttggaaatgctgaaatcacctgccttctgtgttgatctcactgggagctgcaggccggagctgtttctatttggccatctttattctcttacaattgaaaaataatgatcttaaaatttttgtctccacaaacaaaagcaagtaaattatctcagtaatatagttttaagaatagttgctcttttttaactgttggcaggggcataagggataagagaagaaatagttaagaacacaggtgggttcaaatctactctctggcacttactagctggggaactttgggcaactcacctaaaccatttaagcactactagttgcctcttctggaagatggcagttgtaataatacataattgatagtgtcattatgagataaaatgacataatgcaaataaagttattggccatgtgcttggtacaaaataagtactcaaaaagtacttcaaagtaattttttattctaggagccattccttacaggtggaaaaattgtgccttttgcttacattttactttgcatttcacaagatgtcttcaagagtatgacctcattttatcccttccacaaatatgagacatagaaattgttagctacattttctagggaaaaaaaaccgagcgtcaggaatattaagtgactcagccaagggtctacacctcataattagcaggatcaagaccaatgaaagtgcctcttggtaagatcatacctgaagctaacagacacgtgcaggcctcctacaacataggtagccatgtttagtgtaggcagcagttggacttctgtatattcatttctggcactggagactgcttctattatagaagttgtgaccttgtcactcatcaagcagatggcattgcttgattagagtcaggccatatttagaacatttctataaagccattctcatttgggcaaacatttttgccaattgaagtgtttcttttcactaattgagcaaacaaatcatgggctatccactcacaagggctttccaccacccatattttcaggaaggcaggtgttgagcttatattttcagaatatatttccagcttcatacactcttaagagaacattgaagcctctttgatgaaggtgagggtctataaacatgcttgtattcattataaggggattgtgattgtcctcatagaaaaatgactttaagaaatagatgtatcctgaagcaagataatatgagtgtcaggctggacacgtaaaatacaagggaaggtagtggggaaaaggctgagaaaagagtactgtagactttacatcacaatgcttaaattaatctaaaatgtaagctataaaatagactaaaattatatatagacgtatgtgcgtatgtgtgcatatgcataaaagtgtatgtatctccatacttcaaaggctaatattcacagatagattcaacaatcaaatacggagttagttttgaaggaaaagccaaataagacacctttgctagactttaaaattttattttaactgaaactacggtatagacataaccatataaactaatctatttacttgtaaaattaattgtttcattgtcattgaatcagatgtgagtgtatttagataagtcaaggtagtaaaagagtataataagaaacactgagacccagggatcatgctaactcagacttctgtcttgagtctgccacataagagcaatatttcctcaggcaaattattttcatagttttgaacttgaaattctcatctgataaatggacacaccaatgcctaacacatagggtagctgtgaggattaaatgacatgcgcaatttgcatggcttcctcatcaagttgccacttgtattagtcggctagggctgctatagaaaataccacaagcttggtgccttaagcaacagaaatttattatctcaccgttctggaggctaggagtctgagatcaaggtgttggcagggttggttctttccgagggctgtgaggaaggatctgtttcaggtccttttcttagcttgtagatggccttctctctgtattttctcttcgtcttctctctgtacatgtctctgtgtccacatttcccttcatgtctctgtgtccaaatttctctttgtcttctctctgtacatgtctctgtgtccaaatttcccttttattacaaggacaccagtcacattgaagtagggtgcatcttactcctatatgacctcatcttaactaataacatctgcaaaaaccctatttccaatagggtcccattctagggtactgagaggttaggcttcaacattaattttgatagggggacacagtacaacccataacaacactcagaagtcactttctcagacagaccatgcttgaccactgatgtagtttggctgtgtccccaccaaaatatcctgaattgtagttcccataatccgcacgtgtagtgggagggaccaagtgggaggtaattgaatcatggtggcagttacactcatgctgttctcatgatagtgagtgagttctcatgagatctgatggttttttaaggggctttcccttttttgtttggcacttctccttgctgctgctatgtgaagaaggacatgttagcttccccttccaccatggttgtaagtttcctgaggcttccccagccatgctgaactgtgagtcaattaaacctctttccattataaatcacccagtgtcaggtatgtctttattagtgggatgagaacggactaatacaactaccttttctaagaacagtcttaccctttcctagcacacacagtcccttgccctatataatatgccaaagtaaatcatagaatcatttattttcttattctttttctatcccccacactagtctgaagtccatggtgccagggccctacttgtcttggaggttgttctattctgggcttggagaacagtgcctggtacaaaatagatccttaacctctggcttgaggttagggctcaataagtaataggtggtataagtatctaaaaaagaatctcattctctatccaaattggtattcactagccatatgtgaaagaaactaaattttcaattttattttaataaatctaaatttaaatatccattagtggctattatattggacagcacagatatagaacatttctgctactgcaggaagttctatgggacatttctagacatagaagcatagatgaggatataatagtgataattcagttcagacccggtgctgcctgccaaattccacaacactgccctgcattgctgccctctcatgacaccacacagctcccagttgatttgttcttctttatggtaccaggtgtattgggtgtattgcaagcattttcttcttccattattaagttaaaaataccccttgaagttttgaaaagctgtaaaggggttgtcttgagagtcccattaacatttatagtgaattctgtggcagcaattttttattttaattgttgttgtctttgctattcagataagtaagcagtaggcatagataattaatgtacagattctgttttacacaactttaagaatgactctttgagaaacatgtctttaaggacaatgaactgagatatcccttacttgaggataaaatatgggtgcaggtacaaggagtcagcaggtgtcacgtgtgggctcatttcttccctcaaccctggaaagtatatagattctcaccatccttgttcagcctctgccttagggataagcagtgctggggtgattttatgctcaggaagtaaccaaaggctagcaaacatctctcattgttggcagtaaaaaccattgctatgaataacaatctatattttataaaactattttggcttcacataaaaatctgatgcttcaaggaacatactccaatgtgccttgaagtatagcacatactccaatgtgttactgaatcctgaaccacacccctaaaggaggcattcattgatatcactggcttaacaaaaggctttggggtggggtgaagggataatacataatgcagttagaaagtgatagaaagcatattgcttatataaaattcagtgctaggtaagaataaaatatgaaatacatgtggcaatgaacttagaatatgctccagttttggaaaaagaatagtaagataaaaccctagaatttggaacatttttaaataacctctattactatcattttaatctttgaacagtgacaaaatatcccacctgctttgtgacttttctgaaaagaatacatggtcacagggtattctctattggaataccattcacaccttcaaacttatcaccatccagttaaatttgaggaatggtaattgatgaccttaagtgagtcaagtcacaattacctgaagaactaaaaatgctactggaaggactagactctaagttggtacctaactaattcttattgcctgaatgtggttgtagagtagacccttcattaggaagtgaataggggaagtatgaaaaattaaatgtgtacaaaatccaaagcttcctgataggtcttttgggctattttgaagaataagacaaacaacagaagcattataattggaggattatagagccaacaaaggcaaagtaggagcatatttatcagacataataaagacagaaattaaagatcttatttatgtttgaggcataggaagcaatagaagcatatatatttgcaaggtctagacatgcctctattcatcaatgcattttagtattttagctcagcgttcattaaagttattaccttaatttatttaatcaaaatattgactctattctcatactgcaaataacttgttacatgatttggatgttaatatgatttttttaccactgaaagttaaactaatgctcatcctttcactattaaaatattaatgtcttctattttagtttagcatttaaaaaacaaatttgtagagatgggatctcactgttataaaaaagctttccatttttgtaaactgcaaacttgcagttagcttaactaaaattacataatagaatttccaaattaagaaattaagtcactcatttgttctgtaaagcagtcacccttgaataaagaaatgcatggttcaacatattttttaagaattcaatagtactttcagctttattgggatataactgacaaattgaaattgtatatattttcagtgaacaacttgatgttttgatatacacataaactttatgaaatgaccattaccatggttccatataaccattgtgtttaaaccatctaattctcttgttgactttcatttaaatgtttgatgtatagaaacctcatttcattaaatacttcagaggccaactgttattttatagaatccaacaaacattactttaatgttaacggaccctaaaatggaaaccaggcattggttttttttattttgttttgttttgtttttttgagacggagtctcactctttcacccaggctggagtacagtggcacaatctgggctcactgcaagctccgcctcctgggttcatgccattctcctgcctcagccacccaagtagctgggactacaggcgcccgccaccacgcctggccaattttttgtatttttgtttttttagtagagacggggtttcaccgtgttagctaggatggtctcaatctcctgatcttgtgatccgcccgcctcagcctcccaaagtgctgggattacaggcatgagccaccgcgcccagtcattggtttgtaatgccataaagaatccatgaataatatagtcgtgtatttatttttgaaagagaatgttcttttaataaagcatatgttttctaatttacacttgagcaaacctttattttaaagaaaaattgagaaatttatgtttcagagttatgagacaccgtcttcttatctaagatatgaaggatgcagcaataaattatccagatgttttggctatagtctttttttattgttgagtaacaaatttccatacacttagcaacttaaaacaatatccttttttttttttaatgtcgcagctctttaggtcagaaattcaggataacagggctggtttatgtgctcagagtctcaaactcaaggctgaaattaaggtgctaaccagctgtgatcttatctggaatcaaggtcatctctcaagatcattactgccactgttggaagaattcagtttcttgcaattataggatagaaatccctcttcttttgctagctgttggctgtagccccctgtgaccttctagaggccactcttggattcttatcccattggtcatcttcatctcagccgtggaagacctcccctctcacacttcatctctctgacttccttttttgcttctagctaaagaaagcactctgcttttataggttttataggactcatgtgattagattagacccaccctgataatcttatcttaaggtcagctgattagtaaccttaattgcatctacaaaaattcctttttccatgtaaagtaatataaccgtggagtaacaccagggctgagggtaataggagtcatcttagaattgtgtattagccaagatgtggaattcctatcaataaatttaagcagtgtttccattatatttgaaaaggagagaagattagggtggctgatcatcttgtatttaaatgctaagaaagacaataatcacagccaaaaagcttggtcacatgttgactttttaggaactcaattatagcaatcagaattgatagaggcagaaatcatactgcaaaggcttaaaggaatgctaagagttctaccatttgagaaataaagaactaccaggcaaaatgaagaaataaccatgtaattgaaaaactgccagaaataattcttaattagatgtagaccaaatgtctcaatagttggataacaaggcagaggccacataattcctctgtgcatcagtctgctcagacattctcatccattgcagattaaagccgagtactaccacgtttgtgccacagcgtctctgtggcctcctccctgatggctgcctgggaacatgttcctcactgcatcacactgcccttcccagtctctcaggaagcttaaaggggtaaagcaaagggaggagactgaaaaaaaaatgacaaattcgggagaagatcttttaactttctgttcattaagtgagaatttgtagatagagtggaaagaaccattgtgatcggggcaggagtatgtgaaggaaaggagggatagactgaagatgtcagagacagagaaggccccaaaggatggaacaggggatggaattaggagaaacgtcctgaaggatagaatggggatagaattaagagcgtgcatggatccatttagtctggaaagtgaaaatcttatttttctgaaatacaggaaaagaacagaaaatgagtagtggtttcaaatgagggagaaaaagcaattacatgtaagaaggcttctatcctctcaacacaacggggctgctttatatatattttctcttctgtaaagtgataaaaaatagtaaggccaaataatatttatgatagttaactgatatgatgcatataaactgcttagagtagcatataccacattataaatgcacagaaatgttagctattttttactatcattgccattattattttctattgacagtaaaggaaagtgaggtaatgttgtgaatttaaaagtaacataaagcttttcaatcacttgttaaaaatagcattgcagagaaacattgaaccctccttaaatgtaaatagcacgattcattgaacatctagtcaagatgactaatctttttttctagtaacgctcaacagtctagaaggtacagaaggcggtgggtatcaaggtttataaaaggtcaggaattggaactctggggacctggttgttctcatgagggcacataccaagatcagggtgagctaggaagtttaagtgataggaagataatagatttatttagagaggggaaattgagacagtttcaagcctcggagatggaacagaacaacagagctccaagcactgggatgcagggctggaggtgaccaagtccacgactttgtctttctaaagtgaagtggaggtgagtctgaagaaattatcactgtgattaaggttgttattgagggcaacagggcaagctagcttaggaagaaaaagtttggcctaggtgtaagatgtagttgtctaatattgaacagcacagattttagaacattagcatcaccacagaaaattcgattgaacagcactgtactagaggtacaggaaagtgagagggtagggtcttacagaaaatgttggagcagaagaaactatgccaaatgaggatgtgagcaaggatattctgtatttttgacaattttgaagcattatttattattttaacgtttctgaaatttggatgagtcatgcaattgatgtgctcatttaataaggttagtgtttatttttgtcctgaaaaaccattaagcaattaataatgcatctcacaatcagtgtcatcataatatcaatgaaatatggtaagagcaaggccaaaggaagggttttcttactgggtggtgatcacaacgataaagaatcaggacaaaaagactgaagagatgtggtgataatgggatatgagctgagttggaaaagaactagccccaagatattagtcagcactttggaggggtgatgaatttgccatggtttaaagtacttctttgagtttacagcacccgactctgtgttctcagaccttatgttgtttgagaattgggctgatggtgagtgtcaggagaatgatgtcagtcattctaaaatagtctcccaggtgctgatgcgctttggcaactacagtaggtcttccttaagattgggcatggaagagacaaatgtcggagaaaaatacccctcttgttttgagtggagaaaatcagaagaaagggagagagatcggggtgtgccgaaagcaaagccaatgtgatcatcaagataataatagccatacattaaggtagtcaagatcatagacttgagatctgaacttggatggagatgatgaactacacagttttagtctcatcaaaaagtcagctacatcagatggaactgaagttgtttgttttgttttactttttgatgctgtaataactctggcatgacttttcacagcaaattagaattaagaccttttaaatttgtcccaaatggttattgatacctgcaataatacttttccccctggaattatattttcctcttaaaatatatgtgtgtatgcatacattcgtatatatagtgtgtgggtatgtgtttgtgtgcatatgtgtgtgcatatatatatataaagaaaatagtgtagcggaaagaactctgttttctaagtcaaaatatctgattttgaacttggggtccagtgagccacttaatttcaggtttaacttctggcaagttttatcttctgaagccagaagtcattttcttttaaaaagaggcaatacttgtaactcttttaaagatcagatgacataaaagatatgaaaatataaactataacgtataaatatactgaactgtaaagtcatacaaatttaagtcattaatgttactgattggagttcatttctcagatttcacatagttgttgggcacagaaaatttggaaactttggctttcattcttgcacagactaatttagcatcatattcttgttctttgctgatttatcaggtaaggaaaaagtcaagtaaaatgatttggatgcctcactgccagggaatgcttgataaattaaaagcctggcttcctagggacattctgactactgttgtttataaccaagatcttttgcaaccttagacttcccaggaaaagcctgggctttgttgctgcaggaaggagaacagggaggaaaatatctttcagatttaatcagtgagaaactactaggaattagccactatgctagggaatacccaatcattattttgatacttttgtaagctgaagcatcatttaggggcctagcaggtttgctttctgatcatattcaaagccttcacctgggtgaactcctgtgagaacctataattcagggatgctaaagtcaccatggtgacaagaagaactcagctggcttcctattcaatgcatctcagatgaaggtgctcactccaggaaacataaaggatatccattaatttttagctttttttgtgtgaagcaaagggtattgctaatatacaacctctggaatagacctgatcagttacccagtctctggaagagggtggtaattgaaaaactaataagggcaggccctagtctaagaaactaaatctaagacagccacctgaagtgtgaagatggaaattgcagagttgagtctggagtgttttataggcttatagctctaacttgcctaattgaacttttacaattgaacttttacaaagaaagtggggatttatttatactcctactctagggggccacaaaaaaaaaagaggaaatgagagtataggagatttctctaggttatcataagaaagaagtctgacaatacaatccttgttccatttatctttttataataaaccacaaaatatttaagagctgttggaattctttgtttcttccccatgctggctattttgccattctcttcatctcaatactttgctgagtaaaagtcttgaaaccaaaaatatccctacaattcatgaccttgagtgacttcaaaattcagttagacaaaacagacagctgagttctgtggttctcaatctttgtacttttaaaagtattcatgctttggttctacccacaaagatcctgatttcactggggctgaagtgttgaaagattttatagccaccaaatcaccctaatgtgcaatcaagggtgagaaccttattttctcatatcccccttccttatatccactgatcttgacttcagttttaccttggcaattcacctccatggccacactctgaactttgtcatcagccagaactgctccaaccaacctcaaaatcttaaactcaaatatcccacactctaagcatagttttctttctttctagctcctcttattacgttaaagacctaatagtcttatttctcaactgctttcttgctaacccttcattgttctcctcataaacccaaacaggagataacaagccaggattaatccacctgtgtgatctccccatttttaacccttgtgtttccagagaaaaacacaaccacttacactggtgccacagcaagttcatactctccagacccaattggatggagcctcaatactgccaaaatcccattcatttctctagtcagccttgtgtccttttttcccaataaaaactctgtctcttggtcacatggacatttccatcctatttctgtttgaggtagaaatctgctcctgtaccttgagtcccacctgcttctgccttttcagttgacttgctccttcacctgccacttgtcttggatcaccagctttagccatggactaagtctttaacatgggtatttaaacatacttaaaacacttccttcaaaaagcaaagcataacagtgctaaagcaaattttcatgggtcctcctctgcctactgccttcctccctctaacagccaaataattttgcatctactctcaattttgcactttcctacaccaaatatactgacatttttagtgctaaatccaggaaattttttcttagtctttgttttactcagattctcttcagtatttgaagagtgtaggccactctctgtgcataaaacagtctattcctccatgggctcctagctaacagcctgcagtttgtcagttttctttggggtttcttgatcctctgcctaccactgaaatggcagtgttctttcgtcagcactttctgctgttaccccatattccagaggtatttagccatggctatgcatcagaatcacctgcaaagccttttaaaatgcagccatccgcttgctatgctcgatcatctgaatcagaattactagggattggggcccaggcacctaagttattcagaaattccacagatgattgtgatatgctggtggtcttcttcacatccatgccttctcaggcattccctttatcagtctttcatctggatatcctagaccctaggcttatattttagatatgtctgcacaagatgtccaaactcactgatgtgtccaagagagcctccttgcctccattcccttcccatctcatccaatctgctctaccacctcccccttttctcctcccccatatttcagtctgaatgagtgacatcagattttattaaattgtacaagccagaaacttgataatcattttgaattgttttatttatccctcatgtccaatcaattgtcaagtcatatcagtttcacctctagtattctccaaagttttttatatacatgggtattactttaggttaagctaagtcagtctgtgttgctataacaaaatacctaaaactgggtaatttataatgaacagaaactcatttcttacagtctggaagctggaaagtccaatatcaacgtgccagcatcttgcgagggctttcttgttgtgacatcatatggcggaaagtgagagggcaggagagagcaagaagggactgaacttgcccttataagggcaccaatgcctcccatgagggtggagccctcatgacctaattacctcttaaaggtcccacctcttaatactgttacaatgactattaaatttcaatatgagttttggaaggggagaaacattcaaaccatagcagccaccatcatctgtcttctgaaatattaccaccacctcctgactgtatcctctgtgtttggctttgcttactcccactaatctgtttttcacacaatgctcagaacatttttttctagaggataaatatgataatatatatttcctgcttaagacttttcagtgactatctgttgctttcagaatagaggccaagctgtaacatggcatatatggcccatcagaacccgacgcctgttctgttcttttgtcaggtcctctctttcattctgcacacagttttcatcacaattctctggcgttcatgattctctcttgtctctgagcctttgtttctttgctgtttttgcctagaacaccctcttcctcttggctcaggtcttacatcttccattcctgtcaaggtaactcctcctcatgttccagctcatatctgatatatcatcttttaaaaggatgtctgcctaaacctgtagaatgggcttaagagggcttcctgtttattctcatactgtgtacaatgaaaatctactcattgatttacttctctctcccacccaactttatgttcctttaacatagaaacttttaggcatcgaagaattcttttttttacatgacacataaactctcaatgattgttgaaggaatgaaatgaggagtattcagaactgttagtaaaaaaaaaaatcagaaaataatgatcaagagaggctttataaagggaaagtcagtagttgaaaagctagaagtagaatgagctgactgacttgaaaagaggccactacttagtgaaaagcacttcattggtatggtaggagttgaagtcagaatgcagaaaattgaggaatgagtggtgtatgagttttctgctgaaacaaagtactagaaacagagtggtttaaacagaaatgtgttgtctcacagttatggaggtgagaattctacgatcgaggtgttggcagggccatgctccctgtaaaggagctagggaaggaactgttccagttctctcttgtagcttctggtagttcctttgcttgtagcagcatccatccagtcttcacatagtgttccttctgtgtacgtgtttgtctcttcacatggtgttctttttataaaggcgtgaggcacactggattagggacctactctcttgcaatatgtcctcatcttcacttaatgaatcatacctgcaacaatcctatttccagtaaggtcacattctcacgtacgaggagttaggacttcaacacatgatttctgggggagacgcaataaagtgttggacttgggtttattcgtggtgctattattgtcatacattcatagatcaatattagcttttaatctcttattttagagtccacattgtagcataatatttactgtggttgccatggaagagaagttagtaaatgactttcactatacagggctaccacactggtttccaaattgagctcttcaaggttgaagatggaggacgatggagctcctccaccacagcaccctctctttgcctaatttacccataagcaaagcaaggtttgaaatccacctatctaaaataagacttttagacatgttggaggatatatttttagtcataatgttgatagcaaataagaagagaagatacaccctcagcaattggagacaagaaaatctgatgcataatttaaaagaagaaaacgacaaaaagtacgaaatcttatgtgcacttattacctaatactttaaaatcttggagatatatatatatatatatatatatatatgtaattattaggtctaagtaatacacaaagttaaacccttcactatcttagttggaatacgtatagaggtatagatatatatagatatcctttcccacacttattttagctcttgaaatgcatagaataggaaaaaaatcagaattataatctccatgggagcaactttataccaaaaaacacagaagcaattatatttgaaacctgctagagtacaaaattctagattatctttagcagtttacttttattttcatggataaaatttgaaaagacaagggccagtgactcattctaccatttgagagcatcgctagggagcatgacattatcacagagacagatatatggtgacttggaaattttttgtaggtaattcctattcttaaacttaatatgagttgccaatttggaacactgctacattatatttatcacagagttataacttttaatggtttgagggatcatagatctgaccacatcaatatttggctcattttcaaaatagaaagtgctgaaacaccaaaatactgagctgaattctttaaaactttaaagctgaaaaaccactcatgtacataaagtgaaataagaatcaacctagtgtaaatggctgcatttttgaaattccattgtaaatcttaataaaaaatattgttttaaaaagccagcatgtttggaaatgggtgtaatttgcattaaaatcagatgagattatttcttggttttactactaagacacatggacacaggaaggggaacatcacacaccagggcctgttgtggggtgggggaaggggggagggatagcattaggagatatacctagtgttaaatgacgagttaatgggtgcagcacaccaacatggcacatgtatacatatgtaactaacctgcacattgtgcacatgtaccctaaaacttaaagtataattgaaaaaaaaaaagacagattgtggatgcttatggaaaatacgtttactttttctagactcctagaaggccattttgaggacttctgtaataattcactaaatagatagaaaactgcctagacctatacttcgctgtaagatagtcctcttttggtctaaccctcatttctatttagctaactagctagtcaggagtgtaaggtaggcagtataaagaattttaaacttactagggtcacattcaaagtaagcctagagtaaaatcaggagatcagattaccccagctactgagactgaaatgtgaactgtattgttgaagagcttttcttcctcacaattgaagaagacataaagactggtgatataagagcaaatgcagacacttttggtcactgttagcttgttttgaatgtgctgactgtgtctgtgtccatcttgaaaatattgaggagtcagcaaaacatatttgactctttacccactttttcttaaatgtttcatagtcatgagtatttcgtgggggaatttaatctatgtgcctatgattcatttacactagtctcatcaaaatggcatagggagatattgaatggctaagaatccttaaagtttaagaggccatttaaggcttttatctctgaaccagaaagtcatagtgtaccaggactactcccaattcaaacataccagggttcaattttgttttgtctaatatatcccaggaaaccttactgtttgattcatgatttctaacctcaaaatgctggtctaacatatgtatatatatattaatgaagtccaggtaagaagcgcatggctagaatgggaatgttcaacataaaaatatcccagccaggcgtggtggctcatgcctgtaatcccagcagtttgggaggtcgaggcctgcagatcgcttgagctcaagagtttgagaccagcctgagcaacatggcaaaaccctgtctctacaaaaaatacaaaaattagctgggtgtggtagtgcgtgcctgtagtctcagctactcaggaggctgaggcctgagaattgcttgagcctgagaggtggaggttgcagaaccgagactgtgccactgcactcaggtctagatgatagagagagaccctaccaccaaaaaaaaaaaaaaatgaaagccacattttgaataactaaatttgaatatcagcacagttgcctgaggatgtatcaatttacagataaatgccttcctaccaactgaagaataactagtgctttaaaacttttcatccattaaaggaaagtcacactgaattactccgttggtgttgtgcgatattctatagtttttaaaatgctttaaaatacataatcttgtctgattaggtaaacaggattggtattctctccatttctaaaaggggaaaatacaattacatagaagtttgtatattgttgctttatgtgtagtaacatagactcttacagttctgagctatgattgtatgcaataatagaagcaatgctgcacatatctcatatagctctattttatttttaaattcacttttctcatacttgtaagaaatctttgactttggttttagttaaaagataaaacaaaatcataatttctatgataatacaaagcttgaatattatcattggcataaaattcagttctaatttttctccaaaataagatgcttactccaatataattatcttccttcttaattttacatatttgcattttaaagtggcctattcctatggggctaatgtcagagcagagtgttctttgaactcaatgtgtgctccccagtcaggtcaagtccagtcagggcagtgactaagaaatgggtcagaacttacttaaattatgcagttgcctggaaaaaagttcaacttatataatatatgggaatatgtgaatggagaatggcttcccccttaatgtgtaaactgtaactcaaaatatttttttgagttatagaaaaatttttttgtaaaaaaattaagaaaaaagttttttttaaaaattgagccaaatattaagataatcttcatggtgaagcattactaaattaatttaacggcagtcttaatgtaatgtaattttggtttactgatatgtaatcagttaatcttgaagatttcataagttctggcatttgttctttcctcttgtttctctcttataaattggtcaattctccaaaatatgcaaattaaatttaatgttaacctatgtgtaagtcaaggcatgtgaatcccatgaccaaataaatattacaaagcaggtgtctctacactgatgctgaatacctaccatttagagaagacaactctcttccccagggtctcaaggcatctcattcccctggctttcccccttttcccttgaggactctgcatcctcctttgctgcatcctcctcagctttccaaagtcttagcatggacatgtcccaagcttagtccttgcagtcttctgtcctccttctgcgtatctcttacacctcatctaatcacaagacttcaaagtctatatgccattgtttgtcaagtctctaccgatctggatctctcacctgatacagactttcatattcaactgccttcctgtcatttccaccatgatgtctcctctatacctgaaactgagcatgtccaaaaccaaagtattgctctttcccagcaaacttgctcctcctggagccttcctgatctcagaccaaactttgttgttgtctttgactctttttttcctcacactcccaattccaatccaatcagcaaatccagccagcattctttcaaaatataacccagaatttgcccatttctcaccatcaccatggcaaccagcttggttccggccaccaactttcccacctgtgttgctgcaccacctcctgaccagtgtccctgcttcagcctgttttgcacccctcagcagagtgaggctgctccagtctaggtggcattaggtcacttctttgctcagaatacttcagtaacttctgattttcctcaaaatgaaattgaaggtctttataataatctactattttttcctgtggcctctcagattcagctcctactcctcctcctctggtccagtcactctggtctccttccattcccacaactatccaagcaaagtcctgcttcaggtacttcatgttctcaagtccttcagccagaacttgcatcagcctgatatgccattgttttctttcctcacctctttccatcctttatttggatatcttcagagtgaggctatccttttattttgtttttaataattatatcttcaccatgcctgttcctggcattccccatcccctcttctttttaaattgttctccctgcaaactgttatcatataatccttatatagatttcactttttctttttgtttatttttcatctctcctaccacgactcaagagccctagttatttcatagttcactgctatatccctggcctttagagttgttcttagcatatggtggcagtcaataaaaatttgttgaatagataaataattactgtctatcttcctctccttaggtagaagcaggctatataaaatataaattattggattgtcagacttgcccatatttatattcaaatacgataatccaacttggttgttggaatctgtaaaaaaaaaaattagaacatccatttttaaaagattgaacaagcagtaatttttttccaaatctaaaacaaacaaacaaacaaaaaaaacagtgtcaatcaaggaatcagaatatatattgaattaattgtttttaggtcattagtgaacttgactgtgctgttgctctcaaagcactaaaaatagctgatatcaaaccaaaggtccttcatgatccttgaaacttccttgcagttctaaagaaaaactcaagcttataggaagaagttttaatgagacattgtgctgttcaggagagacaaaatcatagtttctgacctcaggggcattgataaaataagagagcagaagctctagggaaattagtttttaggaagtggaatccggtggctcattgcacattctaaatagcatcagagtaagaatgacagtctggctgattggctttagtgatgtggatagatttggctgctatattatcaaaactggattgaaatccctcaatatcaatgaagttttacaaaggtataaggactactgggccacagttcattctaggacttcatttaagtgacaaagtaaggtgggccaaagtgagattgggacaataagctaagtaatcttaaatttgttcttgtgtctatcctgatttgatcaatccacaaatattaatatttatggaacatttactgtgtaccaggcactgtgctagggagattgtgtaacagtgaccacagcagatgtaaaccctgcccttaagaagtttgtatcctagtgtggagacgggcattcagacagataaatgaatatacaagtgcaggttgtgatgagtgttacaaggggaaatacaagggtgctaggggagagaacatgagccatatgggttaaaccagggctatcatctgactgcttgtgtcctcccaaaattcttgttttgaaatcctcacccccaatatcatggtattaggaagtggggctttgggaggtcattaagtcatgagggcagggttcttacaaatgggattagtgcccttatgaaagaagcctagatccttttccccttgagccttgtgagcttgcagtgaatagatagttgtccatcaacaaggaagtaaaccatcaccagatatccaatctgctgatgccttcatcttggacttcttagcttctaggactgtcagcaataaatttctgctatttctaatctactcaggtattttgttatagcagcctgaatggactaagacaaccaggttgtcattaaaatctaccctgaaggttcagtacgaatccatgatgtatttgaataagatttgtatgtgaatcctctgtaaggacatccagatttgtggtctagatcccatttcttcccactttctaagagaccttgtacccctagcccctgtttctttctgccagcattttctgtttttctccactgactccttaccttctgccattatcaagttttacctattttgaaatataaatatcacatttaattattctccatagccttacagacttcatgtcttcaccactcaaaacctcatgtagtctccttttccccctcgtttacttattgtttcattgaggtgtatttcaatgggtttgaggcatgatcccatccaaaggactaatgtgcatatactcaaaatgttaattcagctgaactgctcacatctttgcttcattgcccatgtctttttgcactgaattgtaagccactaagctttgaatcaatgaacattttaaaatgttatttgtatagtgtctaaaaacatgtggcagttgagaatagattaatctgttctagaccaaaataagatcctggtgaagaggattttaaattcttgagttgaaagctgatcaaggtggaaccatataatgccacatgatacagtgtgatgtcagatagattattgtaacaaacacataattaattagtaatgaagtaatagggttttagatgtttaatcttcaagctggtagatataaattaggtcacattaaaatcagttctccagtctcaatagctctatgctcatattctccagcataaacctcagtaactcacacaacctctttcacttagcatctctgagactctggggggtgccttgcaattgcccctgcatggatctgcccaggatgtcactttgtactggtctctgctctaccagtgaccttgacccatgttcattagtctcttgattgcctaacggcagacaccaaccagtttgttccagctatgaatgttctctgttgtatctagggcagtaccagaacactattcacctgcagagtagaaaggagagtacatctcccttcttgctctctcaggggaagccaacagctgtgctgcttctggagctctcaaattctaggaatctagtgaaaaaagttctttcagttctccacacaactctttgtatttccgggatatgattaggagagttcatatgccagtcaccacaatctgccaagaaccactacacctttcaggaagctcagagtttgtggctgaggttcgggttattcataccagattccttttttctgtagagtgaattcttagtcagagacccattttctgttttagtgagaatgggctacaggaacaacaccaaaagctcagttgcttagaagagtagaggcttatttctcactcaagctacatgttcatgacaggtttgtggtggagggagagggttctgctcttcacttaggaacacagttaatgggagacaccacagtcgggaaagttcccagtcattgtggcagaagacagggcacttcatacacagacctcagtggtttcccccagaagtgacacgtattgcttctgctcacatatcttttttcttttttgtcttgtttcatcaaatcatagtgatattcagattaactacatatatatatgtgtgtgtgtgtgtgtgtgtgtacatatacaaattagagagatatacgtgtttctcatgctgctcacattttatttgccaaagtaaggttaccatgcctaacttcaaaggggcaagaaagtgcaatcttgccatgtgccttaaagagggagaactgagaatggtgacgaatagcaccaatgatgagtacaccttcttccttgaagttttgcatctatatccttctacttcccatccaatcctgccttttatgacatatctctctacatatgatcttcaatcatgtaaattgctcagtatttctctatattaattagtggttctggctaagggtctctcacgagttgttggcttgggctacagtcatctcaaggctcagctgcttcctcagtgactcatatagttgttggaaagcctcaactccttgccatgtgggcctctctatagggctaaccacagtattatagcttgtatcccccagagtgagagatgagagagacagataggcagacagagacggagacaaaagacagagacatcccaagacagaagtcaaacacagtctttcataatctcttcttgaaagtgacatgtcatcactgctgtctgataaccaatcctgggatagagtgggagggggactctacaaagatgtatgttaaatgccaggaggtgggagacttcatggaagctggctgccactctcattcaagaaggctacttactcttatgtaaatcttggctgccaaaaattgctgtctaaatcatagcttcttccaagtagcatacccaggacagggtaaatgcaatttaaaacttctctcaagggggttacttcatttagactagtgttggtgttctcctatgcaattaaatggttcttgtgtcttatcattttcaatgtccaatatccaaggaaatacatgcactcatccacagaatattttctttatttttaaagttttaatgctgtttttaagtcccttgtgtttaggtggttgttatacttgaaatgttagcagacataatacacagcaaataaattcttgatggttttgcttatcctcttctctagaagcatgcgctgtgtgagctaagtgtgactttaaataggacatagggaggaattagaaatagaggcaaagtggcagaaaccccacattaaaatccatccttgtcagcactctctgatttcacataccagggttcttttcggattaatcaaaaaattgttgaaacgtgttaaaggagaaatgcaattctgtaaggggaacacagttcctatttggagggaaggaatatgtatggccactataataacaaattaggggaaggcatgtgtgaatttttatgcactcatcgtcctattgagcacaagtagagaggtttattttcttttcttcattaattgttcttacagaaataaaccacactgtgtaggaaactaggcactcttccctacctactcctgctattgaaagagccttatctatggaaatcctcaaatcagcttcttcttattgtaccagtgatgtctcttggattaattcagacaaactgtgcagtgtaaccaatgcagacagtatgttagaagcgcatggatagcttgcttccttttcattccttcttccttcctttattgtttccgcattgtggttccttgtatcctaccatcttgaatctcttgtacctctaattatagtatgctcactatatgcaaggtttctcctcccacctaccccctgctgcctcctctactgacatctcacttcattcccaagaaaaacattgccctcccctccaagctcactgtgtttgcatttctctgctcttttccgctctcctccttggcatgctggtttaatcaattttaccaaatgactttcctggcagctgtaaaaagaaaaccccagagcaagttaatagcaatctaatactgcactttctgtcatttctctaaaacgtacagaactatttggtcattggattgatttttaatgatctaaatgatcagatgtttcaacgctgcactgcagcagcctgataataaataggaaaggggaggggcatggatgctgggcactcagtcagtgctagatgaataatcctaaaacagcagccaaggagacaagataaaatgtcagcctttgccaaatcatatattagcatttttaaacaaagacacctctttattttgattttgcatatggggaactaaaacaaaatgtttttgatgagggtttaggaagtcatcaatagggttaggaatcaaattacagcctaattctacgcgtatctgttgacataagcagaacgtcagtaaagtgcctcccaatatctctaaatagcctcttggcatctgaaacgtagggaaaaatattggttactttttaaccaaaaggcactaaaacttccaaaggtatatgaaatcagtaaattataaaacatgtccccttcccccccttctgtaagaaagaaatagaaaacaaaaagagagatgaatatggggaaaataaacaatgaaataatattatgaattaattgtaagacttgctaactggctgtgtaactttgggtgatttgcttaactattctgtgctttgttttcctcactgtaaagtggacaaactagtagtacttttgtggaagattaaatgaggaaaggcaagtcaagtattgagcacagtgcctggcatttactacttacgaaggttatgttctttattactccatctactctttccataattgcatcccctccaaccagtcctgtccagccttctccgaatccacaggacaattctggtctcccagtatggtgggcaaaggtaggttttggtgtccaagcacagctcagccatttactctccaggtccatgggcaagtaacttaacctctccaggttcctcagattcatcatctataaactggggaatattagtacatgctttataaggttattgtattaaaggaaataacttgtctaagtctcaatgcacaaagtcttccccagaagacagacttgaaaaaatattaactttatttcactctcctcctgctgccatttccaatgtgctgttgcatgtttctaaatggtatgtggaagaaagctgattagtttctttgctaattattaattgaattcctttagttaatacaatgtattcttttgagaagctcagctcaatttatagtgctagaaacatacaaatacagaatttatacgagttgatctggggttcacatagatgaaagggtgttttcctagcacattgctctgagaatactgtaacactcttacttcatgtatattcatgtatatacatatgtatatatctatatatgtctgcatctacatatgaatatatgtatatcaactgttcttatttagtatagttctccctgaaaaagaaggtactattttatttttaaatattggatcttatttttaatattggatctatctgtaataaagtagccaagttaggctgactacctgtctaatgagtttcccgtttagatggattagttccatttagtctgttccatagcccagatcagacagttcactaacaaatacacttaaattcacatcactttggtccagagggtgtaactaaggcccaaacctgcttctggtgaaagtgacccagaggtacgctttgctgataatatcaggagcatggtctttgtaattggaagacactgtctcccatctccccatttgttattgcaagaaaattagattctcattgaaataacaggcccaagaattatagtaacaggagtttgaacccctgtttgagaatgttggtactcctgggataaatgagatcaattttagcctataataacggtgctttctacactttttagatgttagagaaagtctggcagcaaagcaaagctttgtatataccatgggaggcagggttggagaataaaagaagaaagagagacttaagaacaaaattgtgtttgatgggatgttttgattttctttaaatactttaagtctctagaaataacaaatttattatctgaaatacaaataagaaatacttatatttggaaagttgataaaactcaattattgtgtaaaatgttcacaaatttccaatggatagaaaaaaataaacttttgcattgccaattattgaatacttattttcacctttggaaatagcaagtcagttacaaattttataaatctatataattgtctttatacataataaaaatattctgatgttttgtcagccaatatgcagttttaagcaccttcaaccctgttacatgtttacgggtttggaagttactggggaggaggtagaaaggtctgaccttctccccaggaatttaatatctggtcagagagaaagaaacagacttttgttgttgttttgttggtcttataaacagtgccaaaatgaatgtgtgtatgtgtgtgtatgtttgtgtgcacttgagcaatcatttttgtaggataaactcttacaaatgtaattgttctgaaatggtatgtatggtttacatttttaaaaatttgctaaattgtactccaaaatgtctctcctaatccatgtttctaacaactgtgtatgggtgtactgtttcccaccccctcacaatctgcatatttttagtcttttaaaaaaaatcttaaacgaatgtgataggcaaaatacctcattgtagtttgatttatttttggttatcagtgagattgaagatcttttcaaatggcttttgactatttatagttccccttctgtgatggttatttgcatccatgtcccatttttcttctgggttattggtcttactctaatttatagactctccttaaggcaaatgataccaaaaccataccatggctgtttacagtcgaccctcccagcttacgttgcattaataattgcttcttagaagcttatgttattcatccttctcctatttctacactgctgttttcttgcttccctaatttaacattctcaccattgcagtcagcaggttaaatggcaaacatctgaggaatcaagggaaacaactatgcattgagtacttgcatgtgctacatgatttaatctataccttctaatgtaatcctgaagaaatctaggagatatgtatcattgttttccagacgaaaaaattaagatttggttaaggttgggaaatgagactaagtaaataaagtggtaataagagactcaggtctgtccgatgatactaaaagcctgtgctccttccagaaaaccacgctttcttcagaaaaactgtttttacaagactgtattcaaacatatggcatgtcttgatatacatctaagtaaattttaaaattatatctatattcttaactgtccaataaaattgtgtatttatcatttacaacatgatgttttgaagtatatatacattgtagactgactaaatctagaaaattaacatgcattaactcacatggttatttttgtgatgaaaacacttaatatccactctgttaacatttttcaagaatacaacatattgttattgactagaatcaccatattgtacaatagatttcttgaacttatttttcttatctaactgaaattttgtttcctttgatcaatatcacacttgcacctccatttccagttgccccagcccctggtaattaccattctaatctctagttctatgagctcaactgttttaaatttcccatatgaatgagatcatgcaggatttatctggatatatacctagtagtgggattgctggatcatatggtagttctatttttaattattcaaagaacctccatactattttttataatggctgtactaatttacattcccatcaacagtgtacaagggttctcttttctccacattcttgccaacacttaatatcttttgactttctgataatagccattctaacaagtatgaagtgatagctcattgtagtattagtatgcatttttctgatgattagtgatgtggaatagtttttcatatgtctgttggccatttgtaagtcttttgaaaaatgtctttttagttcctttgcccatttttcaataaggttattttcttgccattgagttgtttgagtttcttatatttttggatacaaattccttattagaggtatagcttgtaaatattttctcctaatctgtaggctgtctcttcactcagttgattatttcctttgttgtgcagaagctttttagcttgatgcaatcttgtctattttggcttttgttgcctttggttttggagtcatgttcaaaaaatcattgcctaaatcagtgtcatatagcttttcccctattcttacatttatgtctttcatccactataggttgatttttatatatggtatgagataaaggtttatatttattcttctgcatgtggatatacagttttcccagcaccatttattgaagagattgtgtttccccaatgtatgttcttggcacctttgttgaaaataagttcactgtagatgtaggggtttatttctggctctctattatgtttcattggtctatatgtctgtttttatgtaagtacgatgctgttttggttactacaactttgttgtgtattttgaagtcaggtaatgtgatgcctttggcattgttctttttgctcaaggttgagttggatatttaatgtcttttgtggttccatatgaaatttagtattgtttttttctgtttctgtgaagaatggtattggaattttgatagggcttataatgaatctgtagattgttttgtagattgtttcagatatggacattttaatattaattcctccaatctatgaacacgaactatctttgcattcatttgtgtcatctttaatgttatacagctttgtaactattataaatgggattttaaaaatttctttttcagatagttcgctgctagtgtatatcaacactactgatttttgtatgttgattttgtatactgcaatttctattataatgaatagaagtggcaagagtggccatcttttcttgctctggatcttaaaggaaaagctttcaacttttccttgttaagtatggtgttaactatgtgtttgtcatatatggcctttgcttgttgaagtacattccttctatacttaatttgttgaggggtttttattatgaaaggatgttcaattttgtcaagtgctttttctgcgtctattgaaatgatgatatagttttcgtcctttgttctgttaatgtgatatattacatgtattgatttgtgtgtgttgagccatccttgcatccctaggatgaatcccacttgatcatggtgaacagtctttttattgtgtttttaaattcagttggctagtttgttgaggatttttgcatctatattcatcagaaactttggcctgtagttttctttttttgtagtgtccttctctggctttggtatcagggcaatgctagattcgtaaaatgagtttggaagtattccaccccatcaagtttttgaaagagtttgaggaaaattgatattagttattcttttagaaaaatttctattaacctagcagtacaagttagctagtttacacttggggctctgaggagatgtaatggagaaagagctgaaattggggttcagatttataaatctcaagttttggttgagcacgaaaggagagggagtgagactaatgataagaaggttaaagtaatcactggattgatttgggatgggcagtctcaaaagtgctgaggattcagttcctatttcagtgagctggaacacacaaacatagaggaaaaagaaagacagttcaagtataaatttgaatatacctaaatgtgtgtaaattacggaagaaacaacttcaaaagaaaataacaacaatgacatgggctacagaacagttaagattaatgatccctcattatagggtgccattcagacataggagttaaaaaaaaaaaaagcaaaccagaaccacacactgcagcagctccccagttgcaagcacactgaaataacagaggcctgccttcacgggaagaggattagttctactgtgacctgtttatataaaaacaatgttgtgggtagcaagattactagaaatgacttcttggattataaaggacaattatgatagcttaggccactagctttcagtacattccatctggtacgttacaaattagctcattattctgctgttcttacgaatgtgttagtctgcaaacatatcattgtcacaaattagtcacctagtgtttctctgaaagtgatttaatataagcacacccacatcataggatggaacagtaaaatgggtccttgctagatcctccaaacagaattcagcataaagcacaattcaatttccaaaggtttttggcacatacatcatcttctgattttctaagatgaaatgtgattgttgccctggatattggtaatacattgtaatattagaaacctcttgggtctccccatgaactctagagatccaagcctactgagaaatgatgggtccacaaattgagcatagcttttatttgtttttatttacatttgttatcgcaggtgctatcacaactgttgtttcaataatagcaatttcaatttgaaaattaacttaaagatcttattttgaagtgtgttttgtagcagatgagctcacccaccagctacttggaaagaagaagaaaagtgaggaaacataaacttcctctgctgtctaactggattacctactgagacatccccttgtgtgggttataataaatatttatggtaaacttcttaagttaagatgcctttggttgcaagtctggagcccccaacttaatggcttaacaaaaacaaatgaggaaaatgtactgtcttataacatgaattttcaaggtaggctattccagggtaggttattaagaggttcaaacacatcacccaggttctgctttgccatcttagcactttgtccttttgctcagacttactctcctcatttacacaggatggacagtcatagccagacaccaggaccaaaggcagaaaatgcaccctttcatgcctgagcaagaacttgtgaagatatatttttaagagagagagaactgagtagtgccgtgagtccaaccctaccctctcttaaagcgggctgcagttatctaactcacattaagctcaaagagagacctggccttcagccatttgatgtccttcccaagaggaccatctgggaaagccagtttggctccaagagcaagagttggtagggatggaaccactagaaaaccaaggccttgatgggggtgctggttaatcagcagcaattggaaaacaaggctcttgcttgagtcaaaggagttgcagccagaggacccagcagggataccaattatgaacccacaaaagtaccatgagacaaagaggcagctttcaacatctgccaggtctccaacatgtgatgccatcttacgatggcactaattcaggaaaacaaaacaaaactcttttcttcctttcctcaccactttctgtgccttccaatcccagaggagtcaataccaacggctagccagcctggatagccaaggaaggggaagagcaacccagtctcaatgccacccacttactccactgcacacagagactctgtggtgggcccagctgggagaggggagaaaatgtaagttcaatcaagtttagagttttgggttacaatttgaaatggacattctaatttctggatagagtctgagatgatggtttagcatgaatgcaaaggtctctattgcctaacagtacccagaaaagtcataagatgttctttataaataaagtttaaagggacagtttgaaagcaaataaaatgtgttttacactttgggagaccaaggtgggcggatcacctgaggtcaggagttcaagaccagcctagccaacatggtgaaactccatctctactaaaaataaaaaaaaaataaataaataaataaaaatagctgggtgtggtggtggtgcctgtaatcccagctctttgggaggctaaggtagcagaatcactcaaacctgggaggcagaggttgcagtgagccaagattgcgccattgcactccagcctgggcaacaagagctcaaaaaaaaaaaaagaaaaagcaaaaaacagcattttgctatctactacatgtcctcattttcagcaaatatgttacaatattgatatccatttacaaatatttttaactaccttgacaataccatatcatatttgtatctttcttgcgtgcttcccctttcttactctaatatttgaggggaaaattatttatgcctcctagcaaatatgcttctgatctttaaaacacctctgctccagcaaatggatcccaaaagagatgtgcattcaaggtgtggaaaacagcaggtcactggggggaatgggaaagttaggatttttattttttatattgctagagacagggtttcattttgtcacccactgcagccttgaactcctgggctcaaaggatcctcttgcctcagccttgcaaagcaccgggattacatgtgtgagccactgcactggctgaaaattagtattaatagtaatgtccttctgtcctagtccactgtttcactttcctttttcttcacggcttcctcctttagactcccttggactgggagtttagcactatcacctgcacactagacctgcagtctatgaagagaggctgtcagggatttggggctatcacagttgctcctcccagagcaaaaaatattcaaccctcccacacacacaggcagcagcctcatctcaaatggactgtgcctctaatcagtgagtggttatggaagacgaggagaaaagtgcatttatattttcattaactttgttcctgcttcctgtagcattttcattttgaaaatgagttgggaatttcaaacatcaataaaacgtgctgaggattctgacaacaaaatccttttttgtcatgtgctatgttgcccacttcctgctttttatttttgctccagtccctgtttgattgctaatctaaagggaaagggagggtcagtgagaaaagaggagaaatcttaaaaatgaatttactatttgatcaggtttgctactttattttgtggaaaattttaaagctcttttgtgtctttatgtattttacaaatcttggaactaaaaacaacagataaaatcacattatattccccattgaattatttcccacatttcaaatgtgcttcccagagagaaaagtataagatacagagctaggcaattcagtttcacattaatagttttgtgtctcatcagtttgggacgtgtattgttcatgttttgctttgttgtgcctattaagtgatttatatagtctattgcgatttttttaggaatggaatatgccaattatagagagaggtaggcgagttaaaagtttcaagtgctcagcattatagattcaccctcgagtcagaatgttaaaaacagcaaggaagagtgtgtaaaatgctaggtgaatgagagggcatctgtccacaatgggcaactagtatttaataactagccttgaatttattctacacttgaatgcaaagattattctacttaattatactacagtgactttgaaactattaattattctaaattattgggttctagtttaaatacatttttatatttttaagctttcaaatgattatttgaaaaaatttatctgaatatcctttttttcctaaaaaggaattctgccttttgagtactaaattattctctctataaatctaaaaatatcacagtatttcttttttttccaaaatctctctctctctctctttctctctctctcacctctccttatctgaaacaaactgacatttaatgaagaaaactgtgaaaaggggttcgagaaaatgagaagctagtattttgattggaagtgtaatagatgtcagtcagagaaaaagaacagtctccagaacatctagatgtggatgtagatgtagatacattgttaacgccactctgtgcattttaatttaagccacttgatcatgtaaccattaattcaatgtcaagttcattcattgtagctattcaatattacaatatagcattaattttaaatgactttatttcaggagggaaggaaataatttatgaatagcaacataaggtttcttatatgatgactcatcacaatgttgattgcaaaaaaagaagctgactcagactagctcctgtagaaaagggggaacatagttactatgaagatacagaaattaacagaaacaagtatagcagggcctattggattaggaaaactgaaattaaggcagctactctctttggggccatacaatcaccgatttctttttgtctctgtgtttctgttctttcctgccttctccctgtaattgccactgtctctttagttatcagtttgcactgaacccaaaatggtaacttcagcccctgagtctacaggacattttggttcaaccccaccttgaactgattagagtctcaatttcacttaggacatttcacattccaaagagcaaatattaatatttgctgcctagtaaatgaatcagatgtcagtgagtcaagttatcatgcttattcccatcagattttataatggtgaagtgtaggaaaggcaaggtctttagaaggaaacataggcagacataagtaatcatgtttggtatagagactcatttattaaatatttatgataataaaatacttaacaaagtcaatgtcaagataataaggactctgagtccttattatgcaccagatactattctaggcattagaggatataccaaggacaaaacagaccagaaaaccccactacccctagagcatgtaccccactacatgctgatgataatctttagtcatctatttcaaaaataacttaaaaatggagtggcaatgtctctgcgtagtcaattcaagatgccgaaataaaaatacatgtatatgtgtcttccttgtgtgtttctttttttttttgtatttctcgtgttgaacttgcatggttttctaaatgaaatattttcatttttaatgtttcatatatgtgtctgtatatatatatgtaatatacatatgttataaatatatacaaatatatgtatttgtaaataacatagtcatatttgcttttatacctaactctgttaactgccaatgatgtgtaattatatatgtgcatgggttagaagtggtggatggggcctttggattttaaatggcattttacctgcagcctctgatgcagcctcttccagcttcctattaaagtgactgaaaacactgcaaaaatatatatatatataatttttaaaaagcactaaaaaccagtactggcagaatattaaagaagcgttaaattagattgacaatatatatggtggaccacacattgtattccattctaaaagtaggaagaataatttcttagttttacctggaccatacaatacatctactatgtcctactactgtagtagtatatgcagcgatatactacttaagatttttaaaaagaaatatacaagcagacctaaaggtggatcaaaactaaagagttaagaatagaaacatccagaggaataccctcttgagatcatctactggtaaaaattcatcacaagagttttaaagagaataataacttttgtaagccccatctgattgaactgccttccccagtaaacctgtgagagtggagaggtttgagtattttcatggtaatttctttaccatgtgccatctggcaaataaaagagttcttttccaggcagtactttttaccaaattcagaggtcggtgaaatattcttacaacaacataaaaatcggtggtaaacccactattcctggaggggaggaagactggaaagaagtatactgacttgtcttttgggaatggaattatggatgacttgcttctttcttgtgtgtttattttattttatttttgtatttcccatgttgaacttgcatggtttcctaaatgaaataatgtttcctctttaaaaagaaactttaaatgatattgaatctagttaaaatgaaactatgtgataagtttcagattttataaatagattgtcaaaatatgtgttaaacattcttgataaaattacatctttgcttcaagcaattgtaaagaaaatggaatctattgacattacaaatagcaattttagcatccataaatttgaaattgtataaaaattgtacatattctgggtataaaatgttaatgcttgtcatgtaactttgtaaaaactttattttttaaagcatttttaggttcacagcaaaattcacagaaaggtccagagatattccatttactccaacccccacacatgcatagccaccccattatcaatatcccccccacaaaagtggtacatttttttttacaattgaacctacattgatacatcattatctctaaaacatatagcttacattagaatttactcttagtattgtatattctatgggtttgcacaaatttatattgatgtatatcttccatttttgtatcatacggataattccaacatctctggcatgtctagttctgatgcctcttctgtctctttaaactgtgttctttgcctttaactatgcattgtaattttttcttcatagctgggcatgtactggataaaaggaactcctgtaaataggccttaagttatatgggtgggccaggcatggtggctcatgcctggtaatcccagcactttgggaggtggaagcaggtggatcacctgaggtcaggaggttgagaccagcatggccaatgtggtaaaacctcatctctactgaaaacacgaaaattagccagtcatggtgacacatacctctaatcctagctactggggaggctgaggcaggagaattgcttgaacccgggaggcggaagttgcagtgagccaagattgtgccactgcattccagcctgagctacaagaacgaaactctgccaaataaataaataaataaataaataaataaataaataaataaataaaataaaaaagttatgtgggtggtggtgtggtaaggggcagtggaggggaagctttctatcattccataattaggtttcagacttttggtgagcctgggcctctggattgtgaatctcctaagtgtttttcaggttttttttttcttataccataggtgagagagaatggctaacgtgggctggaattgagtatttcctttctccttgatggtaggctagagtgggctggagttgggcatttttctttccccaggtcagtgaggctctaatataacaaaacaaaatggaacaaaaaaccccagcaggttaggctctgattaactagtttctcctcaggaagaaccaagcttcagcagatttaaagatgtgtactttttcccttctcttgctggaagcatgagagaatttttctccaatatttactgtgagaacttggtagcactcctggaggtaaaacacacagaattgtggggacctccctattactgggttcctctggagtttttcaactttcagacttgcctgcactcagcctctaacgatttgtcaattatagttgaggtttttctaccccagcactggttctcttggaggtttctgctccggtatgttgtgattctccatagcctactgtctatctcaccagtggtttgggcagcagtttgccctgtgacctcacttctcttatggatctaagaagagttgatttttcagtttgttcagcttttttgttgttaggacagattggcaacttccaagctccttatgtgaggaactgaaagctggattatgttacttttttactgggaggttgagtgatagaagaactgtcatcagaagtttaattaaattatcaatcagtaacaatcaattaaatttccagtgaaagcaaatctattttggatacatctaatcaggataaatgaaagaataagtgtgcattcttacaacatttctcttttttttttttttttgagagccattacaggtgcgaaccaccatgcccagctgataatatgagtaagttttgaagttgggctttattttattacatgagaaatatttttgctcctttgaattttctaaacaaatattatacaaagcctttagaaaagcttaagatataaatgaaatgtaattccatttcagaaggtagttttgacattacattatttgtattttttcttttttttccattttgattccagtaaattgcaaaacaaatgatctgtattttattatattttactaagcaaattttaaaggtatatgcaaacaacatttaaagagctcttcttattaaaaaattttaaattataataagttaaaattataataatctaagtgtttgtattacttccatgctacggataaggaaattgtgtctcacagaggtttcatgcgttggtcaaaattacacaaaaagtaaaaggcagaacctgaaaataagggttcacatcttaggactccaagatggtatacacatttgacttttttgtctttaaacttgctgtgaacatttttccacttttgattcttaagtataaatattaagtgccttctttgtatttcagtattaggcttttaagtcttctacttccaaaaaaaaaattaaaagtaaaatttaacaagcattctaaatattccaattatgaaatatatttcatattatgagatttttcttctgtaaaagaatttatcatttaagattagaagatttaaccttgaggagtatgatccaaaatggctttttatattagttgaatcatgaaaagtcccaacaaagcatttgctggttttaggtgatgaaactaggtgtttaatgaatttattttttcttttctaattggtgattgtaccctgggttatgagaatatgtagaaattgaatgtagtagctactagcaacttgctgaaacatgatgcatttccctgactctcagcaactgaaactgcggcttcatgaaaggcttctcgtatttcagttataaatgttcagaacagcatgccttcagactttgctagaacttgccaggagtggaaagtcatgactatcaacatcgttattagttaacattgactgagtaccaacaatgtttttggtgttataaatatagagaagaagacactgttctgttcctgggggattggctttctgtaaaggtgagatagagaatttggtcttgaatgttcttttcttgctgggaggtggggttggaagcacagccacctcaggtctcattctgatggcacactcacctctttattagttgatgatatatgcaataaaaagaaaaaaatgtataattacacatacatacacacatgtgaaaactcatgtaaattttattttttattggtaaaaaatatatatttatggggggagcttgaggcaaaaagtcacatcctgcaagatatccaggtgacagtagcttctatatccttgtgtataatgtatttatactgttattaatagtatatagaatgtgctaagaaaagtacatagaagtttttgtatgtgtaaatatatttatatgaacccaatatgtagaatacagggaccaagtgttttgtttttgacatctaagggacaaaagtaatccagcctcttgaaagaatggagactttccaaaaatatctgaactgattattggtattcatataagataaataagtcatcttttaggtctttattctttgatgtctaaatatacaggagttttatttcatcaagttatttaagaggcaaacattgacattagctattgattataccaaaatgcaatgatgacaaaaaaatataccttaacatttgacattaaagttactttctgaaagtgaaactcagggaaaatcaatgaagtaactcatcacaccctctgataagtacaagtgactaaagagtctaggaaatacccaacctcaggaactagggtgtgactttattatactatgcttatactagcataaaggttgaacttaatcattcttttatgctcattgtgaaggaagtgtgtaagttgaaggcattttaagaggatgaaatactgaaactgatattacagagataagaatttgtgtagaaagtattaattctgtatttctactgttacatttttgtaattttttttaaagagccagactttttttgtatgtattatcaaactttgagataaaactagttaaagcagaagagctcttgttgaaacagcacaaagtacctggcttcctagacccagcacaaagtaccttgcccctcagctgacctgatgcaactttgaaaaaccatagggttcccagaaacttagtttgaaaaccttcactcttatgagcataaccctataaccatgagagaaaagggttttattggaaaaggacgtgggacaccggctagttaatacttctggctctgattctggatgcattaagcgatctttcaatgaaaatgttgaaagtattttggtttgctctgagtttgtagtttatcaattaattgagctttttattgaatcagcctcatttaagggtagttaatataagttcacttactcttgtgcttgctgtgggattaaaatttaaaaaaaaacacaaaacaaaacaacaaaccagtctttgctctagtagagctgaggttatgccatagctgcagggacttcactgaggttatgccaatttgtggtgccctgctaataattcgcactcctgtattgataaaaataatggggctgagattagccataaagataatcttttatggttactcctgatatttctttttaatttttttagagacagagtctatgtttcccagcctggtcttgaaatgggctcaagttatcctcctgcatcagccttccaagtagctaggactacaggcatgagcaaccagaactggcttcctgatatttcttaaaagtttcatgaaaggatgattatcttttagtgtaacaaaatagattagcattaccctaacccaacaacattttttcatttttgacaacttgtttttagattacaaacctattagttctgcctaactgttgtttcttgaaggccatacatgtaggaagtattaaatttgtaaagtatcagcctataaattagtagacataactcttaagaccctctttctaatataaatggaataaaatgctggaaatgagttatttctattttctaagcaagcctattcttttatatttgttgccttatgtctgcaaaaatattcaattttggattgtttaataatgtgtagtcttgattctctgaactgtgaaataaattacagttttttctttgctatctttcaagcagaaatttggcttttctgttatttatcatagtttctcagttgtgtttccttttgttctaatttgttagactttattctagacagttgcatgtataaaaataaaaatccaacgaaaattcactttaaaaatattcagctaaaatgtcctcttagtttaagtatatttagtagtttaatggccaaatcatttgtattttatttataaagtgctttgcttatatcattgcccgcaaatggaaatgtagctaacaagtattgaatgttgaactgtgtggtagtggagaaagattcagaggtattcttactatcctatcacccataggtgatggtttgacatatgaacagagtagaataaaatggactaagaaaataatgtcagataaatgatgttcattacaaaggaaaatatatttttacatctttttaaaaaatctttgcatttgctactttctatggagacctactctcttgtataaggactgaatgttagttttaaaataattaaaacccatcattatcatcatcatgatcaaagatcactaaccagagtcaaataatttgaattctcttccagatctactgctcacaagatgcctgataatgaacaaatacaatctttttggcatctccaaaatgggcataataaatgtcttaatctcctcagcataattctgtgatgccaaaataatacatataacaataatattttagaaagtataaaagtataacaaggtggtattattatgattacagaggtgctagaatattgtggtaatgtgtacaggctctggagccagacttccttgattcagatagtgactcactagatatttaacctcagacatgctacttaacatctgagtgcctcaatagcctcatctggagaacagggctagtaacagtccttaactcatagtgctgttgtgtggattaaatggggtaatactgtaactatcttagaatgggacctggggcattgtagatgttcctagctcttaaataataatatttaaatgtctaatataatatcaaaattttaattacttgattcaaaacattcaaagcttgttaaaaacaatgtaggctgaagttttctgggccagattacaaatgaccttatggaagagatttagtccctttagcaaaaaggggtcatgaggacactgcctaggctacaggaaatctcaacaaatattctcaagattcttttatgctgtagtggcatctttctgaacctacaagttcacattgcttttaaggaatcacccagttcttcttcctcctaggaatcctccttttaggatcatcttttgatcaaaatgaaaattctccaaattatggtggtttttaagattagttttctttatactaggttttgaatttatgggacatgccctccacccaatcttgggtaatattttctgcaatgacaggacctcactggggaaatcctaaatgaagataatagcatgttatattaaatgttgccggtattccatttaatatcaagcaattgcgtaaaagcctttttaaatacctaagttaaaagtggtatattaatgttgagtgtacttctactgcaaagtccattctcccactgatttcaaacaaataccatttaagtgccaacctactattacaagagtttactattttattcttgctccaaaatggcatcaacagtgatggggtgcttttgggggattattgaacagaatttttgcaacaaaggagcaagcatgaagaaatgcaaaacatcagtgatagggattgcaacgttttatctcagcattcctcatatctacacaccccctaatcaaacaagcagttttatggcatgcgcaattgcaattgaagtacaactgacttctgcagaaccggcttccataggatttcctgtccaaaaatcaccatgtggtcatctgcagctaaatggttacaaatcatcaagtaaacaaggcttccccaccccggtgctttttttttaaggagtgaaatccaccaaactctatcatttgcaaattatctctggacttcttttatttctttttttttcactgggtaagaaggaaaacgagcaaacaaaaaatcctccctccgtatttgtttaaggcgtaatttccctgtgaggtgttttacaggcttctccttgtttagcttttcttgcctggtaattactgaaagaagtctgctcttccagggcgagctattcctttaaccccttttgcttgctcttacttggaggttagcaaggagtgcgcggctctgcaatgtctgggaacccacctagagggcccccttgacgccagcacatcccctgtcaggcagcagtctctgcagctgagccaggctgctgcagagttaatgtacagtaccacggagcctgcaagtgtcctgagctgatcagagctggggcggcacagcccagggcagacaaggcggctgcgaggattccaaaggttctgctggaaattcggcgctgggggactccagcaggagcctgttgccattgtgttttaaaagcatgcaaggtctgtatagcttgggcatgagaatctttcagaagatgtcagagcatcagaataaatgacacctattggaaaactgaatttggggtgaaaaacaaaagagattgagagaggaaaaaaaagaaaagaaagacatcgggggaagaattcttagacaacgtctgacttgcagctgtgaaattcattttctttccaaggcaaaatatgaaaagctcccacatggttttgataataacaaaataaaggggattctgcagtgaaaagatcaatagcttagtcattttacttaaagagaacagccagccttattatggggttaggcagcagaaatgaatttcatcgtgacagcatcttctgaagtcatgatggtagttaatggtaatcttgtcctgcagagcagaaattactcattgccttcctacttttgcagttgaaccagcaattctgaaatctgggaaagaagttggctttggtgatacatggtttctagcccctctgcccaggcctttgtccgacacgtctcagacggtagcactgcgttaaagtgaccatacatgaatatgtgcctaagaaagaagaaaaagcaatattcatttctaaaggacagcatggcaaagcaacctgaagttttccatttcccttctaacacttctttaacaaggatatcaagaaactgtcttttgactcctttcttcccacattccagagtccttccttaaggatgcattaatttacactcaaggcggttagattttaccaggacaatatttgccaccatttaggattattagttgaactggttattttagtatgttgactaactagtggaacctaaatggatggacccatacctgcagtgctctgtgatgtttcttttttcaaatcctggaaggccttttgtaattgctatttgtttttattggtggggggagattttttttttttttttgggattcaatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatggtgagtaatcaatattcccttcagtttgtaaaactcagaattatcaaattccgtgacaggtaccagatgaggatttgtcttgaactagagtattggtatcaagtgagaatgaaaagtaaactgtgcaaaaccgaatattgtctgagaaagtaatggttatgcaataaaaatactttgttaatatgaagcatccccaaataagtcaagcatgaggacttgagaacatttaaattgctaatatttcatggaggaagaaaaaaactttgagaatggcaacaatttaataaatttttttaaagatgaggcttagggtttgttttttgttgttttgctatttttatttgaaaattccctggggaagggcacacatgaatttctgatatatcaatttgtctgaatttctaaaagaaggttaagggaaacttagaatgttgactcaattttaaaataatgctaaaatgtgttggtgcctcacagttaaggatattttagctattcaagaaatatttctaccagaatgaaccagtagaattctagtagaattctaacatatgaatcaggaagtgctcaggctctcatagaacttgcttagtgccttgatatttggtcatctattaaggttcaatgcaatgcattcaggtccctggacatgtgatatcatgtgccatttcttgctggagtttatgactaaatgtgtgtaggaactcattgctgagggtatttataagagcaaaaggtcattattttaaaattgcttgtttttgccatacctttagggtcagctggattctgactttcatagcagaaactttgtgaatgcataataaaggcacatgttaaggcttagtgtctgctaacatgggttgttttggaaatgcagtttgtctgattttgaaagtatatctttcaggtaaatgttctggctggactctggatgaataatagatacctaaatataggtttcggagggctttccagctgcttttatgacaatgtctcaaatgaaagctccctgagagcttaaggtaccaccaaaatcacctgctggtttgttacagagttttcggctttcagctaaaaaatccattgcagagaaggatgggaggcatcctctcccactctaggcaggtgcttattttctaacaacaccagatccatccagagtcgatgctgtggcgtatctaccttttttgctgaccagagctactatccccagtctctagaatgcttgggtgacatgcctgcaaacctcggtggcccacttccaactgcatcaccagagtttcctagtcagggggagccttggtgccattgccttgcttgttctgttggtgagggtcaggcatcagcaataaggtcctcattattcttacagacaaatttacatcaatagtctttaatcttgagattaaaagatcctggaaacagttcctggcacgtagtaggcatttgtcaattatttttcttctatgccttaggcttttcttcagagttcattttatacctcttaagatttgcttgggaggggaaattaccagtctcctttctatcaagtgtaccttgctacaaagcaacagtttttgttctacctaagttctgctgtttaagcccatttgtttatgttgtaatacataggatccatgtactctttgaatgcctgcaattataagcactttttatttttattgcattagcctcacctatacttttgactggaaagaaataagctattcaactctgaagttttggaaagaatgcaaatttgcttattcatgctcctctagatctgtaatacatatgtttgaaagctgtatggagaagttgagagtcctgttggttttcttttgtgcctggagttaggtaacccttcatctgcttcactgcatgtcgtaccaatctgttgttgttgttgtggccaaactaagccaatgtagaatgttaatgctctgtataactcctactcttcctgggccccttgcagggattcattaatatgatgttggactcaaaggaagaaggtggtggtttttttccaggtgacctaattaattttgtgcttggttcttgactttctcaatggttgttgttttcctcttatttatagcctccccttccagtactgcagtaagagattgtaggggtttgttgacagaaaaccctctttccctttgtcctactgtaagagcccctatagggtgagatttcaggctcgtgaattatcgtgcttagaataaaggtctcgccaaattgctcttttcatctccaaagactccccctatcctcattctcacatttagagccttttcttcgtgaagggaccgatcagaagttggcaacaggccagtgctaaggaataataaacattgtaaaagacatatgtgctttggtttcacgagccctagctcatctctagaaaggctctgtaccctttggagaggcgggacttggcatgtgctggtcctctttctgtcctgctttttgagaagcaagaatgagaaaaagctgagacacaggaggtctagggtagtcttcaaattttaccagaagtagtaattgaaatagaagcctgtgcacagagttcctacttgtactctcatccacctgccctagggctggtgtgttgattattgagcaatagtattacaaattcactctttatcagttatgagttaaagttaataagtggtcctattacttggtttaatagaacactaccccttccgtgctaaaagagtggtatgaagaatgtgtgtttcttctttgaagctacattagaaatattagctggaggattttattgcgaaggcttctttccattacacttttcagtctttttactgccaagccaaacaaagataagggtttgcctcactggatagataagtactatatagctcttcttatttttccttctggctagttgttagaatggagagatagcctggcattcaggaacaagtatggcatggttgaaagaagggaaatgcaagtcagctttctaggaatttaaatttcatgtagcagcagttaagaggacctttagaagcattatgacctggaatcacatgccagggtctaacatgaatgacctaacacagtgtgactaacatgttcagctttttgcctgacttaaaagatatataacaactttttataatcttatttgtaaaaatactataatttcatgccagaaacatcaaggctatgttgaatgcaattgaatttcatagctaaacaatttaggagggcattttatttaaatacctttgcatccttttaatgatggattcacatggctaaaaggacagtggaagatagaagctaaaggccctggctaggagaggctgtggaatgctgccatggagggcccctctgaggacaccagaggaagatttgggattaatgattgtggaaggtgattaatgatttgcttatttggtgcttagggtttaatttttaaaggtaggacatctaaatgttttaaactgtctttgtgatgctgagaggtaactccagtgaagaggcaaaatgaggtgactgtggcactttcactcaacatggaggcatctttttccttcttctaggaccctaaattctttcattagactgtccttttccaggtatcaatttctaaaaggtttagtctagaaagttatttgtttgattgttcctctatagaccaagcattcaattcataaactaactcatactgttttattctgttttgatctaaatcctttatggaatgaagcaagatataaatcagtatattgataatatattcatatatgtgttcataatttgcatgtatatgtgtttaaatctactaatataatgaatacgtattcagagaaagtcagaatggcctgccttctaatgaaaagataatccttcctatctagcctcatagagtttcatcttttaaggttttctcctcttcatacattgaaattacagaaactcaatccagaagtgcattttccagagtatgtgttctgaccaatacattatattttattagaattttagggggtgggagcaatattgagtttgatgactatgtatacgttgaaggaaatgacgtatcaagtctcatgtaagataatggagctttgctccttttagttaacttaaaattattgcagtgtctgcttgtcttccagtgaaattgcaggtaatagctgaccttgcttctttaacatctcttcctctgggttacagaacaacccagaaattctaaaatataaataccagactgccagcttaattctgaattcctgttggggccaaatacaatttacttgtaaacacttaggaccaataaagtttagatggagctcataattatacaaactcatctcgttcacaaatccctagggctcaatgttaaagtcagccattgtttaaggcagaaattcaggtttagatatagtgtagcaaagattttccattatatgagatatcgatcctattaaacataaaacttttctcttggctttctattttactgtcttttgttgccatcagctgtatgccccttaattttttctagtaataccttggaatttaaaaatgaaattacaaatgtttatgttttagtgtttttaaaaataattcgattaagtatgctatgatagaggagcaaagttgttattagtaatatcaatgtgcttacaacttatggaaatgaaaaatagtctttagtcctagcagcctttctgctgtagtaaaatagtttgtgcactttaaatcgctgtgaggttacatcttcaaaggactgagtggcataagccagggaggtcttagaaatcttacaaaaggaaaaaaataagaaattattcctcatcatatgaaaattatttactaacaatgtatgatgttttagcttcttttaaattcttcactttccactcctttttgcttcttccttttagttgactattactgagttacttacactaatgttgaggtatttgggttcagagaaaaataggcaagtaaaggaaaattgaaaatagtttcaaattctgagatgcaaagaagaacccaaaaaaactaaacaaccagttttttattgccataggtcgaatgttcctttttaaaaaaatccctcatccttttctctcctctttcaatcatatcccacaaacgttaatgctcattaatactctgtctagctatagcattatccacatttttgcaatagctcaaaaatgtctccaagccataactgctgcaactgcttataacttgatggactattaggtgacgtttccagttgtttgagaagtaccagcctataaacatacccaagacaatatattacaactagggattatgttgtgtaaaatttatacatatatatctctccatatatgatttcaaggatagataatctagagtctacataatcaggctattggctggaaacataaataaactaaaaaaaaataatttaaaaaaagcactccaggtttctaattcagcttctggagtgttaatgttttgtgtgaccttctgaaagctctttgagtttttaccacttttgaaaactattacagcagatatttacccacttcatgttaagaagtaggctattaaagaaaatctcatagcacattggtaataacaatttattagagaccagcctgaacaacatagtgagaccctgtctctctctctatttttttaaaggtagctgggcatggtggttcatgcctgtggtcccagttactcagggaggctaaggtgggagtgtctcttgaattcagaaggttgaggctacgataagccatgatcatgccactgcactccagcctgggcaagacagaaagaccctgtctcaaaaaaataaaagaagaatttattagaatgttgacaatgacatgccaaaatctcttgtataactatcatatacttcatggaagagatcaacactgttgagcactcctctgcatgccatatgttttcacataagttacatcctttaatggcaatataactttctgagaatttcttatccaaatccctgtttgcagatgaggaaggtaatgttcacagagattagataacttgctgaaagttcatatatctattgctagggaagctgacccactcaaaaccaggcctggcctgattttagagcccaatatatttttaatccaccatattgttcttgtggcagatgacttagcactcttgtttatggatctttttgaaaattagattagcagtagaccagagaaaataagcagatttaccctgttatttagcagcctggctaagtatgtaggatgcttactgaatgtgaatagcctttccttgagaaactcttccttttaatgttagaacaatgacctatacttagactgtgtcagcagctctttctgtattttctcagaatgagaaatttaaaaggaatttgtggtgaactctgtttccaaggtcactgtggcctataggatcctttcactaaaaagtgcctctctggacgatatattaggaaaggtgtcacactttgaacagatgaagtagaaatgcaaactacagtacttggtgaatggacagagcctctgttcaaagcaaaagtcactcttcccactgggtacacacttggtgtgtggagcatagatgaattcagctctattcaccatctctgcggggcattgttgagccctgttcaaactgcctatctctggccctgctttgatacgggctccagctttactttgtgacagatgaaatggttttgagaatgctttgccaaaaataaaagatcatccacattttaggttttgctgccataattattactttcttcaaaatattcaactaattgtatgtctttaaacttcattttgtgctcaagtaaagaatattagtattatctgaaatcagatccaattgccaaagaagcattttaatcataaaatagcccaatttctgagttactgaaaaatgtcatggttagtgaattatattggaacaggtggaacacactgagttatttattcataggggatgcccagatgaatgtaataagagtcctgccttggagatactcataaactagtctggagaacagccacagaaacaaataattacagtatagtatggagcatattaatatagatatatacaagttgttacaggagtcagaaggagaaacaacttaactgacttgatccaaataccttaagtttcaaagtgaaaatatatttgatggatttgggaattagtagttactgataatacttcagagagtggtttaagggagtgtctgggggtaagttatatttcaggggtaataaaagcagagaaaagttgtgcaaactacttctttcaaaattttgcttaagaacgaaggaggaggagaagaagaggaggaaagaggagaaggagaggagaaaaacacagtagctagtgaagaacaccaagcacttttaagagtaggaagcatgtccctaaggaaatattctgatacagagctgggaaacttgtggacatgacaccctctgggatagggggaggaaaaggagggagaatgcagataatgtggagattaggtaggtggaaggagagcctgagggagtttttgttttatgccctgtgttttctctgggaagtattaaatggaattcaagatcacatctcagaaagaggaccagggaggagcaggtggaggagcttagtaagatgatggaacagctactagggggaattggaaaggttattgaagagagagtacaagacagtcaaacaagttggaaaaaggtcagtgatgttgaatgaatatatccagtcaataaaagacgttttactctacttgagaaattatttacacaaagtattatgtcagggaaatgagtagagatgtgacagaaatgttacaattcttaattattaaatttgaaactgttttgtgatgagaatgtctcctatggattgtgtttcttgggattccaaagaatacagagttgatcttaattgttgttgttgttttatttggtagtggtggaaactgttttatgaacatattaattagattgcagttccattttcatgacctgattttttgaaaatgtgagatttcctgtgctgccttgaaataactcttgggtgacaaacagaagctttaagatgtttgctttgaattttatcttcaaatgaataaaaatcacagtgggaagaaaagccaaaatgattcagctttgctccctttttaataggaacctttctgtggtttatgttagaatgtcacaaatccatatatatgtaacctgcttttacaaaaatttcttcaaaaccgctatgaagcttacttgaaagtgtcaccagtctctgagaaatgtactggaaataaggaaacataatatgactttaaccagaactgatgtaacccagtttaaatatttatacatttaaattctcttttatgtctccaagataaataggagaaaatgacaaataaaatatgtaagttaagggatattattaaatagccttataattttctaggtcatgagaataaaccctggaggatactgtgactttagccaatattatgaattcctttcatctcttctaatcatctcagcagagcttccgctattattgtcagcattcagtgctcaccactactttatacagagcttgctttgtagaatttttgctgtggctctaaaactctaaataagattctaaaagtcttagtcacttgtcagggaacttcattcttcctctcccttgagtctccatatttttcttttctaaatatgaaaatgagaaggttgacttaactgatcactaaggtgctataaaaatctatgatcttatatcttacctagttaatttactcatttctgtcttattcaggcataattgttcttccattaaaggtaatgcagagaaaccacacataaatcaacaaacacctccaggactgagctctgatgcttttctcaagtatttggcctctcctatggaatatccttagcctgtctaccttgggtattttgcttaattccttctccacaaaacctaactttaaatggcagcctttttcatggggaagacagcagcgttatgcccgttaatgctgatatccacagtatttgagaaaacatattccatatgcaacctatacatttctcatatcttcccaactcttctcttgataaaggtctcaggcccttcctttttcatatatcctccatttaatttaaggaaataacatgatatgaagtcctcaatcttaagaaccttgtcattgggttgctcactatgtttaaaacaaataattggcgtaatgatggagagtcccttgatgttctagagaagaaaggaaagctagcaatgtgacagtgggcaaattgagaaaaccgtagtggtattgagatcagtgaaagagacctcttacaagtcctaaagtaaggcatttgagtcttaaacctttgggtgtgttaattttaaaagaagaaaatatttgtgggaaaagtcctattttttagaaaataatctgtgccagatttgatttttgagagaggttgaatgctaagttgcctcaggatgtcatcatttgaaagggtgaccacattctgtgagatcttcactgcacacaaccttttgcttcaaagaactttctgagaccaagctagcctttgagaccaggtattaacattataatctgttctattcattgcagtagccacctcgactacttttttctactttataccacaatacccagcatggtgttgtacttaataggtactttttaaattttttcttaataaataattatgtgtacagaaaagaatgataaataaaaattatattgtcaggggaaattttaattaaataactttatatttttcaaataatgttattgtgctatgttttgagataaggtagggtcgtatgctataaaaaataatacagataataactatcacatttaacaggttatccattccaagtatagactaatttttttatagacatcattttacttaatcatcccccaagtctgtggcaagggcttgttatctacttactaagggtgcaaccttgggtcacttatctaacctctccatgatctgtaacatagggacagtaaatagttctcattgcatagggttgctgtgaagattaaatgagaaaaccagtctagtgcttagaacacctgtcactcagtaagtatccaataaatattgttatagtacagattaggcaactagctgtgaatggttaaccaggttgcctagggtaatcagtggcaggccacttccaacctagatcttacccattaactataggttgcttggaggtctaaactgcctcttctatatcacattcttgttcagtaaatacagggacaataccttgggttaagtttgaattatgagggataatttatacctcctcatctctcaagcctcagcaagaatcgactgatgtgccctcccatgttgagtcagtgcctaccttatacaggatggattttctgtttatgactgtcttactcaggccctgcttcattagattctctgttcttagcacagtgcctgacacatagtaggtgctcaataaaatgattttagagtaaacattacttttccagaattgtgtcctgggaatttacggcttttaatattaatttcaggtttttaggatatagcccatgtttttggggggatagatactgtttctataaaaattgtcatcttgagcataaataattcccacatatcttgatttctgtcacttgggagagtttaactggatttgtagaagcaaccatcctgccgaactgggtgtatctgtaaaatctaaatgctattgctacaaatcaccttatctaagacaccatttcttcaaaactaataactagctcattcactttcatataggaatctttctttccttgaagatatgtatgttttatcttgctggtgagataaaagtctgtaaattatctccacagctggctctgatgcttgattatgcccctttctgcatctataacattgatgtttcattttaattacttttcatcacagtacatgatgtggtcttcagacatagaccagcctctacgtgtggctcttcgttctttttatacatctttcactgtcaaactaagctctaaaaatcatctccctaatatctcttcacttgccaagaaaatgtactagctttgtattatatgtaatacagcataaagctctgcctcatctggcctcctcctttctagtctcattgtagaaatgataatttttattaatattatcagtgttaattaatttctctcattattctagcatacatatcctatatttgagtttttaaatatatcaattctttagtatagtggttataatcacactatatatgtatagaatgaggttttattctcactttattatgaaagagtatcaataactattttatatcattatatgtagttttgtcagagaacatcctgaaaaattaacttcaatgttttaaaaagccatagttctcagtgtgatggagatggtgaggattggagaatgtcattagggaaggcagttgtatcatttatcagaaataactgcaagactttgttggggggaaagtaataaggagtatgaaaatctggaggttgaagagtgggtaggaagaggaagtgacaggtatattttgataaagcattcgagggtttcatacctctctctcttaaccagtagtacaatgcaagggaaagatcccatgctttaaagctgtattgaaccaagttcaaattcaactctgatgctgactggttaactttgagcaaatcaccttttatgagcatcacttaactcatttataagagaaaaatagaacagttccaatcacccagatttactgtaaggattcaatgagataatacattatttaatttgtcatttttaaaccgcagcttttcccaggcagcatttaagacaaccaacaaagttatatgtgcataacttatagggagaatgttgatgaagggcaaagagaaataaggtatgatgttcctactcacatatgtatgtaatagttaaaaaatatatatatatatattacctttacaaacggcaccagaatcctcttggggaaggaagaaaaatgtctttgctagaagatatttatatatatatatatataaatatatatttatatatatatatataaatatatatttatatatatatataaatatatatttatatatataaatatatatataaatatatatatttttatatataaatatatataaatatatatttttatatatatatatatatatatatttttttttgagacagagtctccctttgttgtccaggctggagtgcagtggtgtgatgtcatcccactgcaacctctgcctcccagtttcaagcggttctcctagctcagcctcccgagttgctgggactacgcatgcaagctgccacacccagctaatttttgtatttttagtaaagatggggtttcaccatgttggcctggctggtctcgaactcctgaccccaggtgatccacccatctcagcctcccaaagtgctaggattacaggagtgagtcactgcagctggcctagaagagctattttgaacgtgcccttgggataggaagaaagtccctgaggatctgactataggtaggtgctcaagtgctctaagggtgaaaacttctctgcataacagaagaagaatttagtgctaaagagccaatgagaatgatggagatgaggcagagaaattaggagagaggacaggatgaggaaaattcgccctgggaaggctgagaactgcgggtatactccataaacagatccctccccagtactgacagtggttcggtgggtgaggggtattggggagggtacagggagttgctaggggtgggaagaccactaatatatgtatgtcttacttgaagcctcaggagtacctgaagtaagtgattttgatggtgttggtggcatgtgaatcaaaatgagctgtgttgtgttggcaaagcaggtcaatgagcccagcctttaggaaattatcagaaatttagaggtgagttttgggattcttactggtcatgaaattaggaagttcaaatcaattttgtttagatctcaagggaggcagagggccttccatctttcaagagttaagcagaccatgaagtccaagggtatgcaagatggaatgtaaagttctcactaagcttcctaggatccagggtaaatcaggaagcttaaacacaaatccccgtgtccattggataaacaatttgatggatcagggaagcacaccacttatgatactaagatcagaaagaaatttgtcctaagttgtgcataaagattaatgatatacatatataaatcatggtatctgctcaacttagtgtgtttgatatattttagttcctctcctgtcccttttttcccctatggatttctgtggaagattgtagtatatttgaaagttctttgaaaattgtaaatactattgttagtttataattaaaagaaagcggccgggcgtggtggctcacgcctgtaatcccagcactttgggaggccgaggcgggtggatcacgaggtcaggagatcgagaccatcttggctaatatggtgaagccccgtctctactaaaaatacaaaaaattagctgggcgtggtggcgggcgcctgtagtcccagctactcgggatgctgaggcaggagaatggcgtgaacccgggaggcggagcttgcagtgagcccagatagcgccactgcagtccggcctgggcgaaagagcaagactccgtctcaaaaacaaaaacaaaaacaaaaacaaaacaaaacaaaacaaaaaacctgtgtaccagatttcattaaaatctgattaaatactattaaagaaagtataataaaatagatagtataagaaaaggataatccaaataaaaaatatgtttcttattaaaaaatggtatgtcttgccaaattttgaagttaaaagcacagcattctcacttctttaacccaacttatagcccattatagcactagattttagaatcctgagtcctatgccatctgtaatggcaacagtcttacagggtgatacaaccttttgtaattcttaaggagacttgaatttttgaggcaaatgttgagtctatacgtggacatttgttgtgtaagagtggaagtggaagtcaaaattctgaacaaggttgctcccaataagatctgtcagctcacaagattgcttccctaggcttgaaatgtttcaagcacaaattcaattcataaggaaaatgagaatcatgaaaatgattatgaaatagcaagcagtctggaaagaggatgtagacgaatgccaaagcttctggaatttatgaaatatttccatttatggggccaggtgaaataagttgttctttcagaaatgtgtgacatggctattatatattatccccctaaaactatttgatcataaaacaaaacaacaaaaacaaaaactgataaacagcaatgacaaaacaactaaataaaaaagaaatgcagttcttgaatacaggatataaaggctcagtgcactttttcattttcttattatttcttttccctggctaggtgagttggctgttttatattggcactaagagtttgataccactactagaatagtcaagtatttgacctggccatgagtaaaagatgtttgattgacagatgagtctatctgtgtcaaacagctttaccttgagaaaaatcacaactttgaaagcagtaacacttcaaaagaatattgaagattgtggccactttcccccacctctccccaaaatctatcttcattcaagttcattataagcagctcctttgggtaatttgggttgcgtgctttctccaccccttctgtatccttggcttcttcagagcgtcaatcaagacaagcaaaagattcaagaaaaaaagggaaatgacctttcagtacctgagtcttcacaccaattcatcattgctaagtgctccaaaactgctgagtacagtatttaggaagtgtccagtacatcagcctggcatatattgttcttaacttgaggttactaatgcctattgcaaatgtgctttacgtcagccaaatgatgtgtttaaaaacctctatgtctagcatgaagaagaatctctttcattctcatgttaccttaaaagattttcataccaatatacatcagggaggagcaaatttttgtttcatatgttacacatgttatggtgcacatgaagactggaaacggtagttatttgttgggcatgtgtatgaattagtatgtaaaatacacagcatttttttctcttctaagttactaaatattagatatttaatgtatttcttttgctttgctaatttattcaaatgtaatcctgactaatccattattttgttaacatgtctacttgattaatgtgtttttcccctcttctaattctgatccacaaattttatagctattcattgtattacttaatctaagtccactaaagattatccttattcatgtttctccattaaagacaacgataatatcattgagttagcttagttcggatagaaatttggctagcattcattatttgattttcttggagttttgcaatttttttttttttgcatatttgtcaacattgtatactcctgaaagcattgtgtttaaaatacctatttcttgatcagtagaattgatatagctgacttacacggatcaataacatgattttaagagcatttcaaggaaatctctcatctgcattgtctttttttctaacacagtttgcactatttacaagtgaaaattttatattactttacatattttcctgtaaaaattagaaaactgtattctttggcacccgaatgtgtccttgaattattaatttgttaattttgtatgacatccttatttattagagaagcaataatatttctcatgggaatgcatgtattaatactttcagaggtccagaaagtatcaggagattaaatactgagattaaagagtactctcttcccactattatgttcagttctgattttccagctgtgtagctagaacaaagaaagaatgtgggttttttttaaagaataagacaaggctagaaggtatgcccttgtgagggcgccactgactgtgtcatcacaggagggccctgatacatgaatattcggtctccaggaagccaagtatgatattcacaaccacataataatgtgctaacctcattcacggtaatcacagataatgtagtatttgtgtctgccatacagttttgaaggtaaaatatggaacctattttggaaatttcacataacatcttaagctgtattaatagaaccagaataacccaaaataaagaggtaatgaatgcacttgaccctgcatcattcagacctcagctggaatattgtgcttccttttgggctgcagacaaacagaagaggactcaggagagtgacaagagaggaagcaagctcatgccttgtcacatataaagtggttgaaagactgcaattgttagagaaaatgatgcagtaattgaaggatgggtactgggaagaggctagttctttgaggctgctaatctgaaatataacaagtggatgcacctgcagtaaaagagattaagccccagaatgagtctggatgttctaatggtcagaacaggcatttcatatgacatggcctgcattggtccaggtggcgaagtaaggatggacaaacatgcgttgtttgcaatgataaaaaatcataagtagatgataacattgatttgctgaaatttttctcttttttgtttggtgtaaaactttatatgtcgtactttttgccttgtggtttttttgtatcttaggacaaaggtattcttaatccctttctttgtcttcttgaaagatgcaaccatgcagaaaatgcatacctcctgtaaattgtttcctgtcttttagtaaacctttgtttaaatgagtcatatgtttagcaattttaacattttaacttggctctaattaatgataatatagcgtgatttatggtcttctaaagaaatgtagacatagaaaatggagatagaggttaacatgtgaagaagagtttgtattttgggttagaaaattaaatattggcttatgtcagtaagattaggccttactatttgattgtacgagtttactttaaatttctaggctttcagggctttgtaaagataaattttattttaaaacagctttagatttgcagaaaaatggcaaagatagtgcagggagtttccatatacccctcacccactgccttttattaaagtcttatatgagtatgatacttttgttacaatgaatgaaccagtattggtacattattattatttaaagtccctattcattcatatatccttagttttacctaaggttctttttttctattccagggccccactcaggataccacattgcatttagttctcgtgtttcatttatctttgctatagaattttctcagattttccttgtttttcattaccttggcagttttgaggagtactgattaggtattttgtagaatgtctctcagttggaattttctgattgatttttcatgattagactgtagttagtgttttggggagagagaccacagagggtaatgtgccatttttccatcacactgtcaacatgactaaagatgttaaccttgatcacctgatcgaggtggatttggtcaggtttttccactataaatgtattatttttccttatttttattattttcatacctaccctttggaaggaagtcatgataaacaacccacacttaagagggtgttatactccatctccttgaaggcagagaatctacataaaatatttgcaattcttctccacagaagatttgcttattctccctcatttaattattcagcatttatgtatatcagtatggactcatggatatttattttatgcttaggttataatccactactgtcatactaatcgtgctgtgaaattgttccagctttggccattgggtactatttcttgtgtccctttgatacatccccacaattgtggtggttttgttttctgttttttgtttgttttgttttgatgcactttcatcctttctagcattacacaatacttgaggcttatcaacaatataactccttcctcatcatagattcagccatttctccaaggagcacacgttcctttcattggaaaatggtattaaaaaccaagatttgagcaataggtgtgttcattgtttttgggttgtcatttccttttggccttcttggctgacagagcaaggacatatatttgtgtataccaacctgtgtatgtacacatatctaacaatcaggaagcataaatagatagatgatagatagataagcattagttcatactgatattttcaaatctaactcattaccacatgggtcattctagcttcttcctcttgcttatctataatcttccactccaacagtgaaaaactaccatccatcatttgcttacttaattgttcaattccagtggtgctgttccatttatccttactgaagttgaaatacataaatataagctgaatttttctcaaacccttagaaaaattatttttcccccaaaatgttttttaccctgcaaactcttaagattttaaaatgtatttgtgtcccaaatgtttttctgtacataaaaattgatatagtcaactttatattgtttgcagttaacttgggacatggataatggaaattctcagataattccacaatttaagtttatctcttgctttcattatttctaatcagcatactctccatatgacaactatatctatgataagaaaattgacttctttacctataaatctctgtactttcttgacagacaccaaagaactacatgttgactgtatcttgctggtaacttaaggagaatagtaacttgtagtttccacctttagcaactggacattggccatactctgatttaccaagagagtccttgtaatcacaaaggaaagcagcgatttggcttcagatattaaagcaactttttttgacgtggctagatggttaggaacacactgaagaatagattttcagtaatgagccatactttcaatgaacgtcccaaggaaaacaattttaagatcttgcataaaatagttcatatgcctcaaatttgcatttaattcttacattaggttgaaagctcatgtagaaaacatgtaatgtaaaaattggagagcccaagaacacagtcatttccccttgggtgctaacaaaaatatactacccaacagtgcctttgtttgcagtctaatattttagaaggaaaaaaagaccccacaagcaaacatgttttttttttcttagtccagaaagaagaaatacagtgtgaacataatacttagggtagacaaaatggccaaaatagattaagttggcatcctttttagctgcagcttccttaaccttgtaccacaccctgacatcatcttcctacatggccacacctcatccccccatagccaaacattatttgcattcatcactcattcgtagatgccaaatcagacatggttcttgcccctatggagtttatgattaactggggaagacatgcattaatcaaattctctttctctctctctctcattctctcacacacacacacacacacacacacacacacacacacacacacacacacatgaaactgtgactggatcagatgctacgggagaaagacacacagggttcaaaaatctgtgaagggtttttttatctgttcagggaaaatcaggaatgtcttctctgaggatgagtagttcaggctgtgatttgcaggatcagtaagaattaaccaggaaaagaaggcaagagagagaaccttatgtggtgaatgaacaaatgtttaatataaaggcagcagaagagccagggtggaggcaggcacagaggtgggagataaggctctggtggccatgctaaagatccttacttcaccctgacagtgatggatcatcacaacatttccaagatcaagaatgcacttcccatctgtgtttcctctaaagtcaaaatatggcccatctttcaaaaggaaaattcaaatgttacccattcagtcttctaacactttcatttcctaatctaattagaaaagatcattctggctaagaggtggtatagtagtttaacccacccactcatatgcatgtgtttgtatttatatataaaattttattttcacatttctttttcctagtggcattagcaaaagcactcccagtttcattgagtctcttttaagttttgcttcccctctcctcctctcttcactatgctctgctgtcttggtgtctccccactactcatgtactctccctccatttctcaattctcatatgaggggaggtgccccagagggtgacgaaggacagtgtggcagaggacaggaggaagaaaacataggcacagctgcacttcagcattctgaagctgtaatcatcctgagcatctgtccagggacttccttgcccagttgctttgccatctgtacttgaagccaaggagcatcaggtgctttgcctttcctcaccaggcttacgccatagccttttcaccccactacccacacctcccagtgatgctgcaactatttctcctctgggctccatgcagtaactttctgggtttttttggttgttgttttagagcatttttgtagacagggttttactcagtcatccagactggagtacagtggtgcagttatggctcactgtagccttaacctcctgagctcaaggcatcctcccacttcagcctctcaagtaggtgggactacaggtgcaaaccaacatgcctggctcattttttatttttttgtaaatatagggtttttccatgttgcccaagttggttttgatctcccgggctcaagcgatcctcctggttcagcctcccaaaatgttgggattataggcattatccactgtgcctggcccagtaactttctaaatagtgtacaggcctccagtctcaccacctgtcccattctccttctctttccttctgcagagacctaagagccaagcggagcccatctccttcctacacattcttccagcctctttaggacctgatttcacaacctcatgtgccacaccccagctgcaccctcctggtggaaagtgttttgcagcttcttaaagatatcattctgcttcattcatcaacctttgtccatggtgttccttctgactagaatgtgtcccccaacccctttgcctggtgagaccctcctcttcctttgagacccatcagaaggcttgtctcttcttggaagcttctcaccccactccagtgctgcatccctagtttctgtgcatcccctgcaacctgtgcatcactttttcaaacatcgctcctcaagtagcattgtgcatgctgttttcttgcctttctcactcacacaaatgggagtttcctgggggccctttgtcatcaccacctgcctgactggatacactaacactcagcctacctgccacctacttggaaccttacaggtgtttctttgattaattaattaattcatgttttctcctcttctggtcagttcttccactttacctgtgcttgtttggatatgcagagctctagctggcgagagtgtccttctggctagattgtctcaccaaaaagagaatgggttttccccatccgggtgtctcttaattttttcttccactcgtgtttggacaaaattatttattgactggaaggaccacatggcaactcttcatggctttgaggccccttaatgagtgtccaagggagattctctctcacttccaagttcatggcagacatttacctacccagtcagcttgaactgagctcatagaagttttatttctggcttttgcggatcattttttatgctgttcctctcacctgaagctccctttctatctctccctagttggataatagtacacatattaaatgtgtaccttgtaccaagtatgctgagacctgcttataactaattttgcttgatcttcatgaatagtgttttgaaatagcatttttctatccctgcagataggaaaactagaaaacaaagaataagtaacttccccaagctcacatgacttgtaagtggcagagctgggatttgaacccaagcccctctgaagctaaagcctgtagagtacatgctcccttcctccacatcacactgcccctgcttgttcacactcaatgtgagaatccacttctcaagtttgtcttgcttattccaacctgttttgcaatgaatctctttcaacagctctatagttcctggcactcacttggcatccatcattttctatgttgtcatgtttggtatcttttcatgtatgtaatgtgcatctcttcttaggagtaagaccagaacttttctgctctgcagttttctccctgtgagggatggtgaaacttggtggctaagagcatggtttatacagacagacttcttaggtttatattctggctctcctctgtacttgctgtatcagctagggctgatgtcttcacttttttatgattccatttctacctctgtacaataaggcaaatatgaatacttacctcagagtgttgttgtgaagatggaatgaattaatggccataaagcacttacagctgtgtctggtacatagtgaccactcactaatggtcacttataattccttcacaacctgtaagggtcctttccacccaggtgatgtccctatgtctcaactgaatgactggttagggatatctttccatgggctactgtggctgcagataattgcattcttatttgagagttatgttaactagtgtgggcttttatttgcttctctctttctatcaatgagtcctgctgcttcaaccctgggttaactgaaatttgaaacctttttctactcaaattcctttgatgctgaaattcctctgcggtcacagctaagcactttgtgtggtaaccttctcttctgtcctcaggcctgctgagatcatctgctcagcagcatgtctgacacctgttgccacctcacccagccacttccttggtgacctggcaatgcccagaggggccctgccagcttggagccctgtggcaatgctgtttgattcagcaaactgatagccttctgacatcctttcttcattttagcagccaaatcacatgcaccttaatatttatcaatagctaagcaacaccggaaggaagtgagacagagcctctgggctagtcactatctctgattttacagaatggttaagccaggtgtaaaatatctcacaataacatgccctgttgtcctgaggattcaattccaccgagatataattaccatatgaggaagtgagaaatagggtttctttctaatacacagaaaatagaaaataagatgcttttcttggccactgttatcagtttcctgttaaggttctgctttgtttaaaacagtcctgttttgcttaaaaacaaactctaaggaatttttctaaaacatgactcaacctaactaggtatatatactgtactttaaagtgaacatatttgaaataattgtgagtgacaaagagacggaaaaacatagattttgaaactagcattattctaatgatttttatcccagtggtttatttggaaatgaatttccattcacaacatcttcatttgtcttctaattttcatgcaatttgaaagggttagtttccttacccacaggatcatcctggtcaaatctcaaaagattggctagggcattctgattttacaggcaaatttatattttgccgtttcaggaaataattccttcatggttatcttttataaagagcttatttgtataatatatacacatagtatatatcaaataaaagatctggtgttataaacataagaataagcaatttcccttttgtgataggaatatgaaattccttctggtagaggacgtttaagagcatgtccaaagaatggctaatcaatgaattctctcattttgtaaggagacacttagatgcatttctgaaaaaaacaaaacaaaacaaaacaaaacaaaaaacactttgggctttctctgtattcttcaagcatttctaaacatttattgacatatgcagtagagaaaaactggtatcaggaggaaggcagtaagtagccagcagtcacaaggtacaaagaataaaatgcatgcaaacatgtacagtattcactttcaggagttaatctacattttatttaatttttttttttttttttgacagcgtttcactcttgttgcccaggctggagtgcagtggtgcgatctcagctcactgcaacatctgcctcccgggttcaagcaattctccggcctcagcctcccaaatagctgggattacaggcatatgccaccatgcctggctaatttttttgaatttttagtagagacgggtttttgccatgttggtcaggctggtctcaaactcctgaccacaggtgatctgcctgcctcggctgcccaaagtgctggaattacaggcgtgagccaccatgcctggtcccttttaaaatattttaacactgagaccatattactgatgtactacttctttctaaaagtaattagaataaatgtacaccctcttctttaaactttgcatttttcaaatttccaaaaacaaaaactaattataagtaaatccataagcaaaacgctgttaattaccacttccaaaatctggaagcggtgacttgctttactaagacaagaaactttagacaggtgaatacttttaacaaggaacacacttaactttgtctaattgagcaaattacaaatcagagctagtagcttgttaattataagaatatctccattacttgaatacgtgtactagtcatggtaggcaaaataatactccaataacggacgaccccactgtggatctgagaaccccgcaggccagcagtctccatgtgattgccaaaagcaatgccgccatataaaccacaggtgtctaccttcaccatgacagaagaaagggttagagattccagaagtcacaattaaatgcttccaccccgaaaagtggatcatatttcattttccaaagcaatgcaactttgttaacctcaaagaggcagggaagtacaattttcctgtggggttggaagaagaaaactggaaattggtgaacagttttgaaatgtctgccataacttttaagtgaggaacttagtgttctcttactctgtcatgtttttaaatatctttttgattgaaatctttcaaggctttccagatccctgaagataaaatacaaactctccaacaagaccttttggccatcaggaacgcagcacctggctctctcactagtatcctctctctgtttgccatgtcccattaagactgtctccagaaacaatgaatttattgttgcctgtttcctgctagcttttccccgtatttacacagtttgctttatctgctgggattacccttccctgactatgctcaatctctatctcccttggcaattctcctccaggccccagacctgagaactggaccagtgctctgctctctcctctgagcttcaccacatcctgtgaaaacttgaacctaattcttactaggttttaatcaactgtttacctgtcttttctccccactaaagatgaaaagtcgcagagatagcggagaacaagaaccagatctcacagtcatggtgccaaaagagtatctaaccctgaattggagttcaatacatacttgttgaatgaatgagtgagtgaatgaatgaatgggttttttttgtgctttcatctacctgattggtagcatattcaggacagtatgtttttctcacctttttacatgctataagacataaaacagataatgcgtgtagtgggttcataataaaggtttaaataaactttacctacagttttatcactaggaatatatttctgatatctattacctttgaactttttatgccagattatgtttaaaaacatggtgtcactcgtaagccacatctgggactgattttcatggattgattaaactttacatttcttcggagtattcactgccaagccctctggtgccatgtcctaaaccaaatatttcagaaacattgcaaaacaaggctgcccttgtgctttggaaacgctttcaaatgacatgccattcctttcaacttgaatctattaaagacttgaaattgtagcaatccattggactatatgtcaagaaactggtatttttaaagggtggcatgtttcttcatttatatgtaaattatttccatgtgctttggagagaaaaatggaaattttgtgaacgtacttagcccttaaagaatgtgattgatccttgatgatgtcgttccagacaacaacaaatacacaagaactctttttgagtgctgtaagaagcttctcaaaatttccagtataatcctaggaaaacatttttttttaatcttttctaatcaggaagtctttaaagtgtattttatcaaaatgttcagtattgtggaaacatactcatgagctattagctatagctgacttttgaggttataggtgaaaagttttcacatcaggaagtttcatgtagaacaaccagcgtcattcacgctcatatctgtggcttatatccaagagggccactggaggcttaggggctttgaagttaacagcatgaaacttctccaaaacaaacatttaatttttttctgttcgtttccttaaacaaagtccatgtaataaatgaaataattttgaagaacattgtaatgaatcccacataccagtgggtcccaaattactggaaatcataacatggctcatgtgaagaaagaattatactattttcaagctgttgtatgttaaactattatagtaagtagcataattggcatatattttaggccgtattttcaataaatcaatatttttgctcaaaaggcaaaatttaataatttaataatctcataaggtgaaggatggacaggtaccatgttaggaatttgacatgtgttgttgctaatagactcatttaataaatgaagtaaatgatattaagcagtttcctcatgaccacagagcacagagccataatttgatttaaatatgagtatttctggctcatgctctttctctttctacctattgccattagtgaaggctgcatttagtttttttttcaagaagtgtctagcttacaattttgagcttcactacccccaacctcatacacacctcatgtggcttagagctatataaaatccatgttttttaaatacttctaaaattggacattcatattatgtgtatgatgttttacatatagtatgagtgcagtgaaagttagtttccttaagttttcctgaattcagctgttaccctagcatgactgcttcagcgaagagataagagcttctttgactttttccactggaatttttcatgccagaagaaattgaacatgtgagcctggtgtctggaagagtagcctggatttatggtatcagatgcacatttttaacaccttcagttttctctttaaaatatctcttcaatcccttacttttctctatttgtttcaacattaaaatatgttatttttcttcaaattgttggcattgacacctcttctacaattcccagtcatctgcatgctactgcttcagaggaatagtcttatatatagaaaatactttttttttctcagcacatttatatctaaacaagagaatgatatgcttttacccagttatctgcgtggctcacttccttcaaggcttcaccccaaagctacttcaatgtaacattttctatccattagattgagaactgcagttttaatccctaaccccactcccagactcccctgctaaagttttctctattgtccttgtcattttctgatataccttctaatttacctatttattttgtttaatattcatatcccttcgactggaatgtgaactccaacaaaagttcatatttattgtcttgttgtatctccatagctacagtagcacttaatatatagtagatgctcaggaaagatttataggaagaaaaaatgaaagcatggtttgcaataaatctaaatctataaacattccttttttagtagtattgttaaaccttacggttcctgtacaaccaggtgtatgccctctagagccaccaataatattccaatattaaatatacataattttataaacaggtgtgattttaatgtctctagacctttccaaccagaaaagctgaatccaggtactgctggtctttttccttccataggttctcattttccctgatgcagttattgccttttctgtttatactttcttccctttaggtgacttcacttacaaatataggaatgctgattcatgtttagcattgtgtggtttcagtatttattttctgtatttccacattgctattttagctcattctttaattaaataaaatgccttattctctcacagtatcagcaactaaaagaaggatacatcacctacagttgttagtgtgaactgcttatattaactcataggatatatattggtagacataaacctactgactaaattatttctgaagtatactctacaaaccatcattgtatttttacatttgacaaagtggaaaaaaaaaaacctggccacaatctttaaccctgcccagtgtctctggcttttaggcacacagccagtcggcaatggcggcaggggtggcatataaagattctagatctcaaaatgccaacctggccagaaaataaaactcactatgtgataccattggaacaagcttctataccaatgtagggggtgatggaggataatatacattgcaaatttatgtaaaaccagaccatgtggtatttccaatagttgttacaacattgcttaaaatgatataaatggccttatggataaaagtagaagtttaattttagaatagttcctattttaagactagatttagcaaaaatccttatggcatatgtttactcttggggaaccttgagagatagtgaacaagaaacgttagatcatagacttcttggctgcaaaaagtttatttatttcatcattttactcgtattccttttattatttgaaaagctttgtataaaggatttttagagatggcatttcattaaggttatatttattagaaaacaaacttgaataatttaaaattacaaaaggtaagtcattttatgtatttgcctacttgtttttgttttctccctgccaccctccctttcttcctttgtccttcccttcctcccttccatccttccatcctttctttattcatgccctgcctatttagaaaaggatttgcagtaagttacaaaaagtacaaagtcaataatttttttttaattcagaatgttaaaaagagaaaattgggtgaagagaaagtgaatatttcaataataagagtcatagtgcttcctctgaaggagcccagaaacccatctcatagttacgtggtggccaaacttagcaggaaaacaaaagaaatgctagacgagaagaacacaacatccatttctcaggaaagactaagttttcctcgtacagaaccctgaaatgtattctcccctgggatactgtttggataaacagtgagtgctgtaatagtcaatgtctttacccactgcttcacagcaaagcagaattcccaaggtaagaatgtgaccatgtaacctcattgcctcaccattgttctctccactctaatatttcagtactaaatgtgtgtgtctcttagggttgctgtgctgaataagtgagagtcacctggcacagcagacatctagtgtgtgctaaagaaatgtacagagaatgagagagaatttgaataaaaaatgtaaatagaatattatacagaagttaggaattaattcacaagtgtgtaagagatactctgtctcagatgtgcaggccactagtagtgcagtgtgacactcactgcctctcaagagaacttagtagtcagaaaagtgaagaaatgacatagcttttttacactatattatgtagaaagcttattttttaatgttaaccaagagcaaggtccataaactctaataccttccagaaagcacaaaagacattgagatacatttagagaaatagaggaaactgagctagatattcacgtgaaataggatcattccacatcttccagcaaataaattgaggtgaccaaggtcccagggagcacagatggtcatattctaatgaagctctggctcaaaaacacacaagctgaaaacaaggcgaggatgcttcataacaatgtccttttgtaggagaagtgaggattagtgatgagggtaggagtggagcaagagacagggattaatttgcatagccaccttggaatcccaaactgtcaatggtgtcagtgatgctgtttgcttgagtccctaaagggttgaatgaaagaagttaactagatacagagttcacagaaggtcaataatcttagctttccaacaagttggagatcggggtaaggagaagggcagaccttaagaaaagagttatacttattgccaggaaacagtgcttccttttgctgtttttccacaaacagatttacctttgccctatgcatttcatcttattttaaaaaacaaaacttttattttaggttcaggggtacatatggagattttttttaatataggtaagctcctgtcatgggggtttgttgtacagattatttcatcacccaggaactaagcctactacccaatagttattttctctggttgtctccctcataccaccctccaccctctggtaggccccagtatgctgatcctctttgtgtccatgtattttcattatttagctcccacttacaagtgagagcatacagtatttggttttgtgttcctgcgttagtttgctaaggataatgcctctagctccatccacgttttgcagaggacatgattgcatttttgtatgactgtatagcattccattatgtacctgtaccacattttctttatccaatctgccattgatgggcatttaggttgattccatgtctttgctatggtgaatagtgctacaacgaacatatgtgtgcatgtgcctttatggtagaattatttatattcctttgggtatatacccaggaatgggactgctgagttgaatggtagttctgtttttagccttttcagatgtcaccaagctgctttccacaatatttagtcttcttacacccccaacccccttggaagtttagaatggaagcacatttcttcagatgattattaactctttgctttttctgtttttactgcatcatttaaattatggtgtggaacatcgaaaagggccctaaagcctctattgtcaagtatgactgacctctcttggtaaagcgagacctagttctgactgagattcctccagtcgtttcatggttaactttccattcagtttcagttgtatttcattgtgtttcctgcccagtggagattcagcatagatgacacctaaggaaaaatgctagtcatagtgtgagaaatcatagccttctctttcaaatgcttttattcatattcctttggacttgattttagatattgctcgccaaatttagccatctttcttggtagacatttctgaaagtttagtgattaaaagcttagagtctagagttaaatggagtctagagttaaatagtctgggtgtggactctggcctggtcacttgccatctgtgggcaggccacttctttaagcctcaattttctcccctaaaaaatggagggggatgggggccatcatgatacttactttataaagtggttgtgaagattcaaggagaagttgatacatataaagttcttagaacagtgcctggcaggctgtaaacaactataaaaagttaatcattattttcagaaaaaaagttgagtcaaacctgaaacagtggtacaatgtcaagagcaggaactttgccttattaattgtgtcttcctaactctatggacttaggatctgagactctagttcctacaaactcatccatcctggggcctggcatatgggagctataaaccacatcagccctcctttgctctttttccttagggctgccctgaggaagaaagctaatgtgtataacatctagcattatgccaggtatgtggccagagctcaaaaaactatagctattattgtattatatactttgctctattttttatactcctggttaatgacggagagctctgtgaggggctgctagagggaaggttcaattattttagaagctttagttcttccacatttcactttgtaatgtttgccttgccttgtatttattaaacaatagtttactatactcgttcctaaaatattaagtatagcttattatgccctgttaatctttctcagtggcatacaataatttaaatatctgcttgaaaaatctcaccaagcattcattttaatgtggcttagaatgttatataatatgaaaaagtacgtgttctttcagaaattagttccaaagaactccctatatctagagacaggctgtgagaatggagaaagttgaggagtgtctctgttaggaatcttactactgcttttaaatttcatggaacacctattaaattgcttcgcagctaggttatgaggaaggggagccctgctcactcttttaaagttaaaagtgaaaagttacttgcgggtgattagggaaaaccatctcagaggagtggactgttggcatggagaccccacatataactcttgggggatggcaaaaacttgagagaggatgctttatttctcacctcctaaaatgcctttcccagctttctgtggtgagagagaatgagacagcagtcatacctaacagttggtgaaacagttctatgggagtgagggaaagtgaggggcctaggatgagtcagaaacatgtacatacggaaagggagagagacaatcctgattaaattgtgccttcttgcaaaaatatatatatttccacatttgatacaaagtgaagtatataaccttgacaaagcgatatctgtcagaaaaaaaattagaaaaattgctttaaataaacagtccttcaaaagatgtcaggcacagagactttctgagaaaatgtttccaaacttttaaggaacaaatagtatgttatataaattttctagagtttgtgaaaagaaaatcaacttttcaattcattctatcaagtagacctatttgcaataagaaggaagtccctcaaccaatcttacttttcggtagataaaatcttaaatacaacttggtaaattgaatcttgcattttgttaaaagattcatgctcatgtcaaataaggccgagtctgtaaatgtacatatagttaattttgatcaaatctggtcacagaatccatcatattaatatggtgaaagaaaaagcaatagacttgtattgacaggtgccacagtggcatttgactaaaacttaatatccatttgttgttagttttttttaaaaggatgcagtgaaatagcaacagaagaatatagtgtttatttcaatggtgaaaccaatttttaagtgtgagtcgtttctattaaagtcagcttagttataagcaataagacgtaacataatatttgtatgtaatatttgtttgggaagttgtatagttattgtcaagttattgttctagtacaacaacttgaaacataaaatataaaatgaaaactgactttatagctatgtgggtatttacctggaagagccaaaggaattagttgaaatgttattagaaatgattcagtaattcagataggtagccaaatacaaaattacatataagaaagctattagcttttttatagaaagtaataatcagttagatattataatgaaaaaaataaaatacctctttatttacttactttcttactgttgtccaggctggagtacaatggcacaatctcagctcactgcaaccttcacctcctaggctcaagcaattcttctgcttcagcctcttgagtagctaggtctacagacatccaccaccacccctggacagtttttcaaaaattttttgtagagatggggtcttgctgtgttccctaggctggtctcaaactcctgggctcaagcaatccgcctgtgttgacctctcaaggtgctgggattataggtgtgaaccactgtgcccggccaattctttttaaatagcacaagattctagtcacaaaaacatactacacctatatttatgagtgaaaataataagaaattagaagggtttttttggtattgttgtgaagaaaacaaaaatgtcttaactaatgctaaacaatccacaatattcattccactataggcaattccaatcacattttatttttgattttaataaagtatttcaaaaatcaagctaacatgggaaaatcaagaaaaagttgaaataaagcacagtgggtaaaggttggaaggatgtagaacacaccattccagagattatatcataaaaattacagtaacatatatcatgtaatatataatattgtaagaattaggacggtggctcaaatgaagaattagataaagttgatttggatagactatagatttcaaataagactcatttatgtatttgtgtgtgtgtgtgtgtgtgtgtgactgaagtagcattttattcaatgagaaaagggatgattattcaataaatggtgttgaaagcaacagctatcgtttgggaaaataatataaagttagattctttctttaaaccttatataaaaatatacattggatatatattttattaaatatttatttaaataaagatttcattaatatataatatataattttattaatgtaacaactaaaaagtagtttagttaaaattactaaaataaaataaaaatgagtatttaaatttcaacatagggaggatatttctaagcatatcactagagcgagaaagcatgaagaaaatgtctgatagatgtgtatacattaaggaatcaaatttttctacacatcaaaaacaccataaagaaaacgtaaaggcaaatgaaaagggtgggattctatttccagtgttactaaagagacattgactttaatgtcttaaaaatccttagaaatcgtccaggtggggtggctcacgcctataatcccagcactttgggaggctggggcaggtggatcacgaggtcaggagtttgagaccagcctgaccaacatggtgaaaccccgtctctactaaaaaatacaaaaattagccaggtgtggtggcacgtgcctgtaatcccagctacttaggaggctgagataggagaatctcttgaacctggtaggcggaggttgcagtaagctgagtcatgccactgcacttcagcctgggcgacagagtgagactctgtctcaaaaaaaaaaaaattcttagaaattaataaggaaaaaaatgacctttcttccaggaaaatgaacacaatccataagaaacacaattggtgagttacatgaataaaaccccaactttaaagaaatacaaattaaacaatagtgaactaacattttctctaaagagtattcaagattaaaaaacaaagtcaaaactagatgataacaaattcagcgtattgactaaagtcaggacattcttattcattagcaatgaaagtgaaagtttgagtagctttctagaagagaattcaagtcacactatgaaccaacaattttactttgaagaatttatcctaagaaaaaaattaagaatatgtgaaaagatttagttacatcaatgtttattatagtggaaaactgaaaatgtgccaagaaaaaaaatgagccaaatattcagcagcgggaattagcacaatataccttgatatgttatcaaggtaaatgtgtatgataggatactgatgcataaggataatttttaacatggtagattttcattatgttaaatgaaaaaataaaaaatacataaaatgagagcccatttttataataaaaaatatatagtcattcaaggaaaacatgtagacggacatcacaaaataccaacaacaggtatggttcaaagtgttataggtggttttcagcacatagattacccctagcaaagagacctctgtgacacttcgtttcttcatctgtgaaataaaggaatcatactagattagttctaaatgcttttagcaaaaatatttcataattctatgagtattgatggttaataaccttgagaaaattgttattatttattgaactttggagttagtagagtaaaaccaagtttatcctgagctatcccttgttttagttaaaattagttaaatttaacatcctgatgtttatttataaattgtgcatgtgtacatgtgtgtgtttgtgtgtatatatatagcgctttctcacaaatgcctgttttgctgtggagtgggttgggtgggtacagagtttcactgaaatgtatattcccctatagaattcttagagacacaaatatatcttgttaataggttatatatattttcatgtttcatctaccatttgaaaccctataaccatttgaaatcattcttggttttggtaggtttctttaattaacattcacattgagaaactataagagattcaacccttgaaaaagtccttttgctaaagagatttgcatgtgctctaaaaattggtggaaaatggttctgctctaatcaaacgaatgtcactctactcttatttctagctaacagtaaaactgcctggaaaatgataacgtacaacaaatatctcaagtggttatttagtaccttgttgtgatagtgaatgaaaaacacactcagttttaatttgctgttgaacacttaacatttcacagtggctggctgtttggaggccatatacaatggtagaaaaagtagctttctaaaagtgctttgcctcattcttgcttaacctggcagacgtcatgaacttccaagagggaacatattttatttgccttataccaccagaggacttggccaattattgctatttatttaatgttggtgttgacatagtgcctttgccctgaggagctccaggtgctttataaaattagtcagcaattcacctcacagcctttacgccagagagtgaacattgaaaataataatgattcgtggaacctacagccacccctaactcctatttctgtttgcccagtgaaacagaacaaatatgcccagttccctcagagagctagcagaaaaaagttctagtggggtgtcatgggagtttctctcttgtgtaactaggtgaactcctgtaaggaaaatttgccatgcaccctgcagagctgagacttactattctctgttgtaggacccatactttccccagtaaggaactccattttttttcaggcctttgctcaaatatcactttcttaataagacctttcatgaccatctgtttttaaaaacaactaatcaaaacctatcctcaagtgcagactttctgtatcctcattcctgcattatttttctctgtagcacatgtagctattcagcacacttagatttttatttatttattaattaagggttgactccatcccaccagatcgtaagctttatgaaggtagaacatttgtctattctgttgagttatgaatctttagaacctaggtgggtgcctggtacctaatgggtgtgaaataagcatttgttgaatgaatgagcgaaggaatgaatgaataaataaattttccccagtggagcaacaagcaacagttggagtcccttgttgtcaatcaaatataaagatagcaaagagtaagtaagcaagagtgaacttgcatcatatcaagatttcttttatattccttaacattgaaaatattcatgtggtgaaatacagtattagagttttctcctttagttgcaaataatagaaactgaatttaagccgacttaaacaaaatagcagtttgcaggatcttgaaactcaaaaattcaaaggatacagctagttttaatggttgtgaggattgctgcaggccctctcatgatttgattgagcgtttgtctctgtctttctctttctctccttctgtctcactgtgtttctaagactttctctatgtggtagcaaagaaagctcagacagcacaaggctgcctgtagtaattcttgtgacatgagagcatacatctcccagtagttccaaggaaaacccagggctgacttgaaacgtgtgcacttggattacaggtcaaccttgagtcaattgtgactgactgaccaggcctctgtgtgtcccggttgtggaggtcagttccatcagtaggagggggattaatcaaaggaaaatcagaattctttatcagaataagaggagaagatgcatgacaagtattcagagatacactgtaaccagaaaaaatggtcatatgtgaagagtatctcattacaacagggaggaatgtagttctaagtcttttaaagttctgctttcctataatatcagatgaccacatatttcacagcataattgtgaaaatgatattttgaaaggaaaaaggaattcttatctgagataaaactgtcaaaaaagtcaaaatttggctgtgaaaaaagtgaacgtttacttgaggttgtcattacttatttccttcttatataattcatataattctatattattatgacattcatataggcaaggtgttaaattctaatttgattttataatttttcaaaagagacttagaatgtgctagaaatcctaaaaatttctgttccaactattggtatttgaattatgtatatactgcccctttttttcctataaaaaactgatagaagttcatagataaataaaattcacagataatgttacaaatttatttcaaatgttacttcttgcctttttctatgccaagatacttaacaaatacttcaaaattgaaagtatttttactccttattttatctattccacagaatagttagaggtagaggaagaattagataatatatttattaataagtcaacatcctattaatggatgaacatagaaccaactcataggcaacacagtcagaaaatcaaggtgtggcttggttggcatgaaagcataatgcccacaagaactactgttgttggttatgctgtactgtatgagaagggcatttctgacgttagctttgatactagccttttagtaactgagtaaagttagtgagtatactcacccagttcagattattaattcagtactaactcagtaatttggtgttactacatactgagatatccagctggattcaggatttgctcaattcaattagcaaatccagtgttaaggggaaaaagaagctttgtgggtaagcatttctaaattggtgtttttatgaagccacaatattctggtagttcgtcttttccttcagttctctgaagttgtaatcatttctaaattgttgctttctaggtaaaagatgtgagataggggaaaggaaggctttcttaggaattttttttctttcattgcccagttaaattggatttgtgatttatatccattcatcctattcatacccatcatatatctgtatacatctgtcatatatccatcctgttcatatccaatccaattcataagacttttccatatttttcgtgagattagatttttttagtgggtgagaagaaataaaaggcacataatattaacatgctcctggcattccagcaacgaataatgccatagcaattttataaagattaaaaataccctagctcactatgattttgatgagcgcaacgcacttttggctttgtgggtcccctcctcataaaaaatacaaaattatattttgtagctgcatttatgtaaagataaatataatctaaactgttttgtactcattttttcagattttaaaagagatttaacatttctatgagctcctaaaattatgagctctaggaatagtgcttactgtgctattggataaactaagctggcattgtcatagctaaattggttacattttaagctgtgaatgaaagggaatttggtaaaccaaacaactgttgtatgcttattgttcattccagtataaatatatttttgctattaacattagttattacaagtggaatacgaaggggtggactcagggtttggaaagagagttaatgcaagtgagtatttgactccatcaacaaaactttacaagtaaaatcctcaggttttgtgcctgtaatctttttacaggatttaatgctattttacttcgtcaacaatttttttttcttcaaagatttgtatttttaaatgactgatgctatgaaagaaaataccctcatgattatatttatattgtgaatttttacagtaggggcaaactagaatttttcatgcggagagcactttgggttttactcaatatagctcttcaaagttcttcaaagttcaaagtaaaaattgatgctagagtaattttcctgtaatctaggtgaaaagcccacatatcatttaacaaagtaaatgctcattcatatttaatacaaactcttttttcttctgttgaagctgacttttatccaatttttagtttccagttatctatggttttgggaaacagagctaatttggattcatgaattctgtaaacaagtatttcttgagaagctcctggttgtgaactacctagaatgaaactgggtaaactaatatcaacatccattcttttgccaaacatcactgataaactgcaacatttttttttttacgtgagtggtcttggaatcagacatttctgcattgaaaacccagcactgttgctgactggctgcatggcctgcatctacttctcacatttctgactgcctaccaggttccaggcactgttctaggcactgaagatgaaaagatgaataatatggagttcccatcttcaaagaagttacaattttaaggaagactggcaaataaaagttaccccacaaaataataaaaatacaggggtaaaactagggcatagttatattttggctggtctctttacctctgaggttcttttgctttttatgtaattggattttaacctcagaagactgtaaggttaaagatgataatgtataaaatcagtactctgagtaatgatcaaaattttctgttgccatccacacatttgagtgagatgtagtgagtgctagaaaataaagcagttcgtatcaaaaagggtgtgttgaaagaaataaactaatccttgagaaacactgtcatgcaatctcatatctagaaattgtgcctatgttctgtctataaattgatgaattggcagggtgttacatttaggacacacattgacactacatatgacatttgtaaaaacacttgctaattcagctaacagctcgcttctccccttctccccactactcactgtggagagagcttccagctaatagcttagaatctcccagactaaccaaccattgatggaaccaggtgctatgtgattgtaggaatttatttgttgctctgaatgttaactaaaagtaatgggcttcttattttgtccttttccttttgtgttatagacggcaaagactgtttctcatcagtctcatatagctaaattagatttatctctcatgctgactgattaaaagggttaaattctgggcacgttgtcccctgagtcctctgaaatccatgtcagaatagaagtgctcattaccagactcgatgaggagctccttttccagaacttctctctgctacactctaaggaccaagcacctctgcctaaattccaagcaaccatggcctgtggcagtcttggaacttttgccctctggcatgggtagaactagcgtcaattgggtaattcaatccctgagttccttcttcaatgaatgagagaatccaggaatgtgttgccagttgccttttccttgtacctagttttccttgctgcagaatgatgacagtctatttccacacctcccctcctgccactacaggatttatggtctgcatgccccagttgtgaagctggcatgtagcattttgttgccacaggcctgtgagtgtttagaagtttgtgtttgtatttccagggctacagtttgaatattgaaggaacaaacagcaaacaattcagaggtcaagctgtgactgcttcctcatttggagagcttattttatgtctgtatattctatactcagattcccacataacttgttttttccaccttcattgctttggttagatgctttcaagtgcattttttctctaagaaatctccatagaagagttgtttacttgaagtgatgggtgagcaaagtttgcctgacgtggaacctcagtaactttcccctaaggaaaagttctggcgtgtaggggtgggcgctcttccatccagacggatgggaacatagccaagcagccaggagacacattgacttgtgaccactgggaaggatgcctagccagaaaagtcccagcagctgggtctgttaatcttttctgaatgaaccagcaggcagttgacctctctaaacctgtcctggattcctttatatctttgtagtcacctttttaccccctcaagaattcccctataaagttgttcttaataagactctttttgcccacttccccctgaccttctgagttgaatatgaatttcactaattggtgaaagaaaccaccatgaccttgataaagccatttctactctggttcctcccttctaagaatttgttcattcaagcaagtatttgagtctaaatggatccacttggacattttaataattatcatgaacctcagtatccttaaagtgtggctaaaacaggctcaaaaaattcagatagtgtaatctactttctctctccctcctccagatttaagtggattaattcacttcactatgccagcacctgagtacagaataatttatttctgtgtcgtttcatgatgaaagtccagctggcattagctcaaattatgcagctggctattaattgaagaaaacttccctgtcactcctcagtcaaacatgatctgattcagcagatccttttcactctcatctcttctattctaccagtagaataaatgtaaataactttcacttggctctgcttgtcatggattgtaaattacctggcagcatgcagactgaccacattactgttttggaggcggcttgtttcagttgattagtatttctagaagagttttgcacatttcatctctgaggcctgaatgatgtccactagcaggaaatattgtagtctgccttttttcttacatactgtatactaaatttcaatctaatttcaacaagatgtcaaattctagcacctgtagggcaggtgttggtcttctatgaattgattatatgtttttctatcatactggatggtgtacaagcccaggttgtattttaaatagaatttcaagagagagatttgttctggaatttagaaatatatattatgtgccaaaattatttgatgagtgcattttgtaattcttaaaatacaaaactacttggcatgaagagatgctatagtatgttaacaattgtggaactttttcataagatgaaattctgtgcagaaatgagggagcagaattcttgtgggagtgctaaaatggttcatcaatttgatcctcacagcatatgagaattcaccaattatattactctctgaaaatatgtttcagtatcaagggcctctttttgcccttcctccatcccaatgtctgtactctctgtacagtgtgatcactgggtgctgcatgaccagtcattattatacgctcagccctgaaaatgaacttaagatggtaaaatcataccttgccaggatttgggtggctgtgagggattcagtaggattttagcaacagggactggaaaagaaatcagaacttggcagagaaaaaaatagcactaggatactagaagagacctgggagaactagcttgaccttagaggctggtcttgtgagtcatttgagaaatagtatcaaaagggcataagagggcccggcatagattaggctatttggggttacaggagatccaaagctagaaggggcaacaaaacattgtggtatgaggccatcctaatttgaacatcaggcacaggatctagtgtccatgaagtagatctcagggaatgggcagcctgagaagaagagtagatcatgcagaagccagcagtcacccctagatccagatctgagtgtcatgacctagatgcaattaaaatccttataatgggtcccaccctggcaggattctttcaggaactcaggctgagcctgaagtgagtagattcagctgaagggaaggtaaagaactataagttgatagacttgcaaaatggagaggctgcttttaggaaaccattgataatagtatcaatcccattgataatatatgtgattgcccttttataaggccatgtgctttctgcacaattatgataaagtatttagccaaacttgtattccctatataaagggggaggagatagtatcccatggggaattccttcccatattataaactggtagacaacttaagcaaaaatgtttttactcatatgaacactgttgaagtataaagccaggtatttaagtcatgataggtgtttatttactttgaacatttgccagaagtttgatgatgggtatatttgtagactgggtgttagaggttgttatattctaaaaagatatcttctgattaattttcttcatttataaaaacaatctattttgataacatttaatttatgaactttggtgtcatgttacactttatacattttggttgtacattccctgtaatgcttacagagacagccagtcaggcaataattgctacatactgagcgccttctattttctgagtactattgtaaattatagagataaagcagtgaaccagacagagtctccatcctaaaagagcctagtagaggatgggaactgatgtagtatcttgtaattgtcacagcatggtacacttgcttcttcagatgccattattaagggcgtcgtttctttaaattctgagatccctaactcagcttatgccagaactgatgagaattagaccttcctaaggtcttctttcttcctaaaatgaatattgaaataaatctataagataaaaataatcctaccaccaagccccaattaagactggatttttaacttgctcttctcagcacaatgacacaacagaggacacagaggttaatggaatgtctttggagcaaaggagatttcaaaaccaccagtttgttagatttgatgatcagctctgcaaaatgtttaaagaagatttcttactcatatcttataagttaagactataaatggtttaaatgggggaggatgtgacaggattgaaaatcttccccttcctttgtggctatgagaattcacactgagcaacagggaagagaaggaactagaacttggaatgagcctgtgtgtgggccctcattgttccaggatttacaaagggctacgctgtcatcatattaaataaatggctcctgctccttgtgccagcttaattgccaccttggctcccgaacaaagaaatcacaattgaggcaaaacatgttttgctattgaaggcaaaacctccttagagcaattttggggttgtttttccatttaattttttaacttgcagaaatagccctctttttttctgttttttggttttttttgttttcgtttttttaaatgatgtacacttgtgctgttaagtttcagcatggaatacaggctttatgtatttaggcagtaatgctgagttagatattggtaccaaaaaaaatgaaagaaagagagcaagaggacagcacatgtcaaaatgcctgatagaactgcatggacagaactaaatgtgcttccctactgttagttacacgtataagtcacatctcaaagcgtgttccccaggttagcatcaatatcacctaggaacttgctggagatgcaaattatctggttccatctcaggcctaatgaatcagaaactctaggtggaagggagcagtccagcaacctgcattttacaaagacctccaggacactctgatgtatgctagagtctgagatccactggtgcaaagaataccataggacagatgtacactaactaaactagttctgtttctcttaaaatgactttgacaatatttagaattttgaagaatggtatagaaattcatagttcgtgtgtgtgtgtttgtgtatgtatgtgtctgtgtgtgtgtgttttagcagaattctattttagaaaatatggggtagacttttatttagttttgttatttttgttatttttgaaaaattaagaggtaagcagagaagtatagccagctacttccataattttgtaggaataatgaagtttattctagcagaaagttatatcttatggaataacttctctaatattctctctagacatatattcttttttgaggcaggaacacaaaagaaaattggcttcttcatcaagttcaaagaaatggtgttttaattatgtagagaagtaatttcattttctcagagaaatgggtagacagatattagtaatttaactctcttcttaagtaatggctgctatagctcttaccaacactgaaagaagtagagtcaaatagatttaaatctggctagtgattagaattttttggggggtagggtgggtgaaactgtattgcagggaggtacgttgtaataagacagctagttattatgcactaccctccagttctttgacatgatagctaagggcatagacaaaaatctgaactctgtggtctttgtacatatctgcattcagattaattcacttaacaaatatttgtggagcacctaccatgggcttatcactataatgggctaaggttgtacagtgagcaagatactcacatatgtgattcttgtgaagccagaggtccagtggtaaagctagatgagtaaacatcaattacaatgaagtataatcacttccaggatgaggcagaatataggatgttatgcaagcagtcatccttgattttaggactgggtgatgtggagttcatgaatggttcatggaagaggcactaaagcctacagtgtgaatagaaattagcaagatgatggacagggcaggcagagacaagagcatatgcaaagttggaaagtggagagttcttgacattaccacattactgaatgtgcatatggtggagtttagggtgcagagaggacagttgcacatgctctggagaatgatgggagatgaagctgagaataatacaaggaagagaaaataacaggccttgctatccatgttaagaattccggacttcattccaacaaaagggaaagtctttgaggttgtagtatttggctgtgctgtagagagtgtattggggaaggacagtgctgaaggaaaggagaccagctgggacattgctgcaataattcagaccggtactcatggcttggaccagcagcaaggggagaatgaaaagtaaagagatttaggaaatagctacttaggaaatagattgaacgggaactggcattcaatatgtgtgacagcgaggaacaggaagacacttgggacaactagaagaacagtaggccattcactgagtttggggtccagcaagaggagtgagtttgagggtgaaattatgtgttccatttgggctagtagggtctgagaagtctgtggttgtccaagtagagatgtccaataaactgtggaaaatgcaatcccttaggcctctttattctcataaatacttctcatgctttttcacagcagaggctaaagccaaaaaacttttacagttgttgattactcccatagtgattgggccactactctcgatgtcagttttaagtgttatgtgaattttagcgttgcagaattttagcattgcagaatttttctgcacaaaatcctagaaagcaacttagtttactcagtgaaacctgcctgccaactaacaagacctattatttttcagttgggattttacttcaacagtggaaactatgacacaacagggatggtctaaccccaatttgagcactctgttctcattttcattaggaatcacttccctgtaatcataaaatggaaatatatttactgtagacatgttgtttggtgaaagcaacactaaaaatgagtagatgaatataacagctacaggataaaataagagttcccatttttaaaaagaaggactatgtttacaacacagctctccttaatgttatagtgttattatagcagtgaattttcaaataaaatatttaaattggaatgttagaagttttcttctatcatatcaaataagtggaaggccacctgtttgatgattacatattcaagtgatagttctcaaaaactaaagaaaaatctcatataaattataaatgattctgcaaagtttcacctaacattttctccatacttatgaagcttctgaagttattttacttttgagaagccacagacagaaaaattaatataaatgagataaatttcaactagccttgagaataaagagagcaaggatagtcatcaacacaattaagaatgaccaaatcctattaatgttttcaaattaccaaattagaaaagttaggaagcatgaataatttatttctgacaacatattctttttaatatctgcattactttggtcggctaaggagataaacctactcatgtgacataccatatgtaaacattttcctaattaataactggaaagcttctatgtgaaatacaaactttctgctcatacataatgtagactacaggcagacagttaagagttggtcaaagctgtcaaagcttgttttatggaaatctcatcttcttttcctgtgctctttatcctagtccaggtcctctgaattcttttactctacagtacttagctaatacagtgtttatcctcacattctatcatagcttttatattaaccactcagcaaaatatgtgtgcatgcacatacacgcacaaccatacctatatttaatcatctagtaaactatattaaatcttctgtaaacttcagataagcctgtttaaattgggggtgggtcgtattgtagcataccaaatggttcatataccaagtatatatttgtcatactatgtggaacagtattatatttaaaactgaagtcttatttcatgtaggttgtaccaaatttgtggtggtaaacattgtatttaggtcattcacaaagagtacagaaatacagattagccatatttttctatagtgccattcagtgtaataggtacacaatacatctcatattaaagaaaaaagagtcttttcaaaagcctgtaagggtctgaataaaggtcttagaaatgtgtcataacagctgaaatctaagagatttggaaaaagtgggagaagttaaatattgcaaatgcatagagctaagacttcttcattgaaagttgggtagttccaacattcatgtggaaaatctttaaaagtagccaaaaggtaattttttttttttttttttttttttttttttttgaggctgagtcttgctctgttgcccaggctggagtgcagtggcatgatctcggctcactgcaagctccgcctcccgggttcacgccattctcttgcctcagcctcccgagtagctgggactacaggtgcctgccaccacgcctggctaattttttgtatttttagtagagacagggtttcatcgtgttagccaggatggtctcaatctcctgaccttgtgattcacccatctcggcctcccaaagtgctgggattacaggcgtgagccaccatgcctggcccaaaagctaattttttaaattttccagatagaacttcatgtgtatttgatatattccattttcgtgtatccaatattaccaaatccatggtatttttattctttgttttagatattctaatcatttcacagcactttcattacacatctgcccagatttcctgttgctaaatttcagacactattctttaagtcttggaagagatcaactttttcagcacaacccatcccaaacaatgtaatgttactgtgctatattaagacaacacatgtgctgatctttttcaggcatttccagaatttttattgaatgtcaagtatgtgcaaggcaaagtccatctagcgattttaggatttccaggacctgccatttataaacttcctggaagaaaaattaaccccctcaaaatgggtgttgacatccagtttgcctttatagctcctctgatgccttttaaaaactatatttacccatcttatgtcaataaaaaggatgtatttattataagttgtggcagatagtgttttatagacaattttatagcccacgtgttaaaggtaaaagcaaagaaattatgctactttgctgtattttcccagtgatttatgtaagtatttattccctgtaggaaaaagttgaaacactattgttgacaacagggcccaaataggtatcagcttgatgtactttatcacatattatctttttgtttttgcatcatccctaggaggtaaatatgtaacactttggtttcattagcatcacaacagattattaggcaaatcaacagaatgaaattaaagttatattatctaattgaaaaaagccttcacttatattttcaagcattagttcttatccactttcaatcacctggggaactttaaaaaatctgatgcctgggccagacacccagaaaaatgacatcagactttctggggacaggacccaggtgactgtatttttctaaatgtctttcatgactccgctgctttagaggttcacagacttccacttaaagaactgctggttaagaaatgcatccctacttgctcggactcccagggatatcacttttcacctgttcctatcatttagaaaaaaatgatttgaatcagctagatacatgatagaggaccccccccccacacacacacacacaccaatctaagcacaaaattatcttgttgtcctcaatagtttgcatggataagtaatgcagaataagcatcatacccaatattaataaatacttaacaagaagcccaagattttaccttgtttcctattttttccttcagccatcacattcaaacctggcccaaaggtttctcacattctggcctccatcaccaccactactgctttggcctggccttttgtcaagctagaaattgccagaatttcctgacaacaggctctgtaagattcagtttagagcttacactttggctggagttcatcttcctaaaaagagactgtgatatgtaaatccacaacctgaaatctcattggctctccattgcctaccaataacccaaaatcctctactcaggaagtcctggatggtgtaactccattgcacacaggttcatcccacaaggcctcttggtaatggggtactttcatgtgcatactattctgctgctcttgtggaaagagtcttcaaccccattctgtataccctggacactcacctgagacccagctgaaacagaccttgtcatctcggaccctgcccttggttctgttgaaagaattagccaccagatccttgaggctgtctcaggacttttgcttcacctttattataacaattggaatgcaggcaaaatagtgtttccagttactaaaataaaactatagaccatacaatatgtttgttttgtgcttatttaactcgcaggggaaaatacccatatttttaagactctggatttaaaaaatctggttgattatatgagaatattgttggcttgtctgtttgattttgctttttttgggttgccaataaaattttagagcaagaaaatcaatctctggaaaatatgtctaaaatgcaagagaaaattccaagaaaataagctagatttcaattaacatgtgaaaagcatttcttaatatatacaatgtttattttacatggataatttatgtaagttattgaataaataatacttttaggtttgggttttaggggaggttttaggtttgggttgcagcagaggctttttcagctgattcaaatatctagttttcaaaatactctgcccacatgatttttagatatgacttagccttaattgctgactcagattttcaccttttaaaaagcaattgtgctttttcatatacactatcaaacaagattataagatattttaaggtaagaaagtaaaagggcatccactaatgatcatcagaatcacctggaagggccaataagccacacattaccaggccccttccccaaaatttctaattctgtagatctgtggtacagcctccaattttttgcttctaataagaccccaagtgacactaatgctgctagtctggagaccacactttgagaatcactgcattaaattaacaattttattggttgagttttcaccacagtgtgcatatctgttgactaacaatgaatagctttgttgtcgccaaacactgtaatgtttccaaatatccatatgtagtcacaggcccagagaaacaaaccacatctatattaagactgttttgttgttgtttgacccccccaccctttagtgttttaattacatcaatcctggagaaaaataactgttttctaatttgggcattacagatttgctaaggcaatagaaaattctatcttaaacctttagatttttagtcttctagtaaatataagcatatgagttccaagcaaattctgagttttaaaaaatttaataaaattgacaaatgttttcaataaaattggagaggcccatttccttgtacaaatattctaaaaatagatgataaaagttctaagtgccattttttgaaagatcagcaaaataattctacaagtatttgtgggcatgttatcttttctatgatactggttataaacttaagttatatgaagacagtgtgttagttaaattatgttctagtcctaccttaaggaaataaaaacaataaggctcttagggcctttcttctgcaccactgcagtacttgctaacatgttttaataacatgtagctgagaatgataaactctaggcagcagggtggcttggagatactaatggaaatgcccagtcaaaaagagcctggactagactgaggtctgaagactccaaataactttctgttatcccaccatcttctcagatggtccaatcatgctacactcagtctagggcaatgaccctgaggaatggtatgtttggcaaaaaagaaaccaaagaaggctactgccatgctttaagattttcccatatatctttttcagcatcttgaatggggtttctgaaagtctgaggagtgaactgtgaccaaaatggctgatattttgagctcaaagaaacttaaatttttaggtaaggatactaagaccgacttaaaaagtatagtatcaataatttacatttctttagctaagaattttcagaccacttcagtgcagatcacattgactgattctctaaaccactctatgaagtgggcaaagtgatggtctcatttttcaaatgaggactaaggtttatttaattcaagtgattaactcttcaaacatctagtagaggctagccagatgcattggctcacatctgtaatctcaacactttgggaggctgaggcaggcagatcccctgaggtcaggagttcaagaccagcctggccaacatggtgaaaacccatctctactaaaaatacagaaattagctgggcatggtggtggcaggtgcctgtaatcccagctactcaggaggctgaggcaggagaatggcttgaacccaggaggcagaggttacagtgtgctgagataacgccacggcactctagcctgggtgagagtgatattccatctcaaaaatcaaaacaaaaaaatctagtaagggtctatgtctagcgcctgcacttcaaatatgtgtttgtcatgacatcattagcccaatccaattttctttcattaattttctgaaataaatattttttgagtttatactatataccaggtgctgctgtaagtgctaggaatataacagtgaatcaaacaaataaaaatctgtgaccttttggagcttacattccaatgaatataggcaaaataatagcccctgcaaagagctccactgcctaatccctggactaaatgaacattacctcacatgcaaaaaaagattttgcagatttgattaggggcacagaccttgagatgtagtgtccgtattagcccagtgggcccaatctaatcacacaagtccttctaagcaaagacttttccctggttaggttagagagagatgtgataacagaaaaagggtcagacagatgcaactttgttggctttggaaatgaaagaagggggcctggagccaaggaatgtggacagctagaaagggcaaggaagcagattctcccttagcccactcagaaaggaatgcaaccctgaagacaccttgattttagcccattgaggcctgtgttggacttctgacctacagaactataaaatgatacattttaattgttaaatcactaagtttctgataatttgttacaccagcagcagaaaactacagaaaagatagacaatattcaagaaaaataagtaaaaaatatatgttggatagtgataagtgctaaggaaaaaagtcagggaatgacataggaagttatcagtagggatgcaattttgaatagggtagccctccaggttaacatttgcatagactcaaaggagatgaagggcaagaacatttcagatgaaggaaacaggaggctaaaagctgagactaggacaatgatcagcctgactagattctgaatatcaccattaaaagagcagtttctacttcagaatatatgtacaagcttcacctgggaaccatgtgtgatgatttaggatgaagtttcaaaactccacagatgacattcttatttttctataagcaaacagtcttgcccaaataacatcatttactttttcatgtttgctggagagttcattaagaaattcaatacaccgtattcaaagaagatgaattcttacaatcacttagaatttggtctaaggcaaacaattgaggatgttcagactgagtctttttggaccatctactcaacatcattatcaaccaacagcttataccccttcaaagggatctcaaattatatttgatcctgagttgttgctataataaatttagagctggagaaaaatagtcattgtaattattttgttattagagaccggcttacatatgctaaataaataaaaacaaaatgagagttaattctatgtgaaattcaccatcaattttgatgaaatttcctattgatacttccaagtacagtaggcctttcgtatccatgggttccacatctgtgtattcaatccaatttttttttttaataatatggttgtgtatatactgaacatgtacagacttttcttgtcattccctaaacagtacagcataataactattgacataacatttacattgtattaggtataagtaatctggagatgctttaaagtatattgatgtgtgtaggttatatacaaatactatgtcattttatataaggaacttgagcatccatggattttggtatctgcctgaagacctggaaccaatccccaaagatcctgagggaccactgtaatctaattgaggccaagtttcatgggtttgtatcctcttaagtacctgggggaaaaaactgtctgatttttttttaagttttagtataccatatattttaattttcaaagaaaggaaaacagaaattttatgatctgtgtcaatagaagtgttaatatataaagcaaagaaatgcctaggtgaatattggcctagtaataaacattctgcaatggtgcttcatgggaaatacgccttaccttgctactcaaaatgtgatccatgaaccagcagtatgaatatcacctggacttggtagaaattcttggaccccaccctgacctagtgggtaaccatctgcattgcagtaagatcccaggtgattcatatgtgttttcaatgtgagaagcacagcactggggccttacccggggccctccttaggaaacacaccaagtattgcatgttttttacatcctgacaggtccatatgaactcacatttttccgaatacagtgcactagcatatctatcatattttgaaaagctattttcatcaagggagcttagtatctggtgctcacgagatacctacagagaagtagacagtgttatgcttttgagaatttatcaaaccttttggtcatataatgtttttatttcaaaaccttaaattggtcaacatatttttaaatatttaatagttgagggatgaagaggatagaagtttaattagttcaaaggaaggtaaattgggaaggaaacaaacttttttgttgaatcagaattttcaggatgaaaaaagacaccagtgccctgtggttcagtgctaacacagctatgatgtgactcttcaaaggtcaatgcttgtgcccctattgctgcacatccttctccttgtcagtgttgatgtgtcattggctggctctgtgtcattggcttggtcttgctttcactgaactttggcctccgtgaaacttctaagtagcattgctcctacctgtgaatcttggaaacacacagggcaagtgaaattccattttcttcctttctttctttttttaatgattaatagacaatttatttaagcaagatccttatagtcatcattgccagacttaatatgagatgttaaatgttccatccaattttccttcctggataagtttttctttcctatccctgtcagttttgaaaacataataccagaagaagaggggcccaattccacacagagctcccaagagtgagttttaggagtgagtctgaaattagaatagacatttgctgatcttgcataggtccaacgaattaaggcaagatcttcgatgagcccttggtggttagagttggttgttgtactgaagcaggtactcttgtttcagctgggctcttatggccaaccgttcagcttgcatctgccagccttccagagatatgtcatatttggctgagtcgagggtcaagggcagagtggccaggtgcgatggagtaaactttgggaatgacattttggtgacccagcacacaactgcctgaaattccattttcatgtgacacttttgtatctgtaaccatcaggtctgttccctatgttttctattccttaacttggctaccattataccatcacatctctttccttttctagtgactccccattagactagctcctatctcataacctccttttgtaatttaatggcccaaagattagcaaattccagaaattcctaaagtaatccaattagctcagaacatcatagagacttttttttttctttgcctcatcctggggttatttatcaatgaaagtgactttagattagatagacactggctgccacatcgtatcgttgtgacatcctgcacttaactaaaagggcttgacttaggcaccatctccttctctcttggcagctgctcagttagatgtttttgttttaaccaaagggcaggacttcaaatgtgaccctatttaactccatctggttatattttgaccttatgctctttttatatcctgattctgtcatccattctcttagctgtccttcccagcttgatgtaatagtattttcccaaactacacccttttccataataaagattgtcactcctccctcaagcttccttaagcaagctttatcatatgtctgataggatctctgtttctgattgtactcagtatagatttgtttcctggcacacatgtatgcactatgtcacttaatcacagtgcccctattagattacaaactcctgtcaccaagggttttgttccctcttttcaaagcagaacttaaaagaattttgcttacctttaagcgtgcagttcacatcattgactttaactggatggtggttgatggctgatggtcaactaacaaaaaaggagttgaggagttgaggtttcagatataacagaaggatacttaagacttttaaggaataaaaaactaatttttcttagcacaatggttcagatgaaagtaagggtgcatcagagaaggctgtcattggtttatttgttatattcctagctcatggtgattgtatgttagccaaatatcttgcatttgattttaaaacaaatcagaagtagatgactcagaaatgttgacaataaaattatggacaagccccttgctacagcagctcttattaattaaatatctgagacagcagaattaaaagagaagaaagtgatatacaatttggaaggtttggaaagctggccataaaattatttctttcagctggagataccttacctacttataatatataaaatttttgaagaaataagaataggtcttattttactttgcagtgaaggcttgaaatatttgaaagttcactttattgcaataggattaagtacatcaaacttcatccattcttatctctctcaaatattaggagtataactttcaactgaacttctttgcctgctgtaatatactgttctatagtgatattttaaaatgaatactttgtgaacatagtactagaaaaaggatagtgttttgaatattttaatagccttacagggttaaaaaaggatcttataaaaagtatgtttagtaccattcaatttttacaaatttatgcatttgcttattcatatatgtaaatttaaaatttacatataagcttatactcagaaaaagataaatgttgtaaacacacttgcatgcacacacacaccataacaaccaccatgccattcagtggttatttcagggtaagtaggattgcagaaacttttacatattcacgttttgcctatattttctgttataagcttttattttggcatgagaagaaaaaaattttaaaatttcccaaaaacattctttgtaatagtcaaaaattaaaatgaacagtgtctatcaataggagaatggctacaccaacaaaaaaagtcaagtaagaaataaaattggccaggcctggtggctcatgcctgtaatcccagcactttgggaggccaaggctggtggattgcttgagcccaggagtttgagaccagcctgggcaatatggcaaaacaccatatgtacaaaaaatacaaaaaaaatagccaagcatggtggcatgcacatgtagtcctagctactagggtggctgaggtgggaggattgcttgagcctgagaggcagaggttgctgtgagccgagatcacgccactgcattctagccagggagatagaacaagaccctgtctcaaaaaaataaaattaagcaatgggaaaagattcctcttgctattttaaatgttgatcaacattcaaattttcagtggttttaggtaacaagacatgtcaacctcctgaaacagtaattgttgtagataataagaatatatatgagtttggctttacctgattttaaaagtggagagaaaagctgaattgaagcaagcatacaattattttctaaacatatcctctccagtttcagtgttttttaatcaaaccaccaggaatggtgcagcagacaatgccagtccatgtctcccccttcatggtcccttagttgtcattaatgggtgactgcagagaaccataggcatttgaggacttaacagagatatgttttatattgagagtggacataagctcctcattgcctcattgtggtttgcacttcaaactgcagcgtgtactttttctaagctctgtggtctgccttcctaggactgcttgccctgtactgttatttcagaatgtttatctagtgaggagtgctgcattgctccattgtgcatcacagggcacaggaagcaatggtatgacatttttgctgcacatctatttttgattattctcaaaagatgaaaatgtttatcactgcaggggtgtattagtccattttcatgctgctataaagaactacttgagatatggtaatttataaaggaaacaggtttcattgactcacagttctgcatgactggaaaggcttcaggaaacttaaaatcatggtggaatgggaaacaaacacgttcttattcacatggcggcaggggagggaagtgcagaggaaagggggaaaaagccccttatagaactatcagatctcctgagaagtcactcactatcatgagaacagcagggggatctgctcccatgatctaatcacctcccatgaggttccctcccccaaaacatggggattacaatttggattacaattcgagatttgggtgaggacacagagccagaccatatcattccaccttttgccctccaaaatctcatctttctcacatttcaaaacacaattatgccttcccaagagtctcccaaagtcttgactcatttcagcgttaactcaatagtccaagtccaaagtctcgactgagacaaggcaagtcccttctgtctatgagcctgtaaaagcaaaagcaagttaattacttcctagatacagtggaggcacaggtattgggtaaatacactcattccaaatgggagaaattgtccagaacaaaggggcaacaggccccatgcaagtccaaaatccaatagggcagtcattaaacattaaagttccaaaatgatctcctttgactccatgtcttacatccagttcatgctgttgcaagagttgggtccccaccactttggcagctccacccctgtggtttttcagggtacagtcccctcctggctgctttcatgggctggcattgagtgtctgcagcttttccaggtgcgcagtgcaagctgttggtggagctaccattctggggtctggaggatggttgccctcttctcacagctccactatgcagtgccccagtgggaattctgtgtgggagcttgcaccccacattttcctactgcactgccccagcagaggttctccacgagggccccgtccctgcagcaggctcttgcctggacatccaggcatttccatacatcctctgaaatctaggtggaggttcccaaacctcagttcttgacttctgtgcacctgcaggcccaacaccacgtgtaagctgctaagccttgaggcttggaccttctgaagcaatggcctgagctgtatgttggccccttttagccatggttgggactgaagcagctgggatgcagggttgcacagagcagggggaccctaggcccaccccacaaaataaagtctttcctcctaggcctccaggcctgtaataggaggggctgctgtgaagtcgtctaacaggctctagagacattttcctcattgtcttggtgattaacatttggcatctcattacttatgcaaatttctgcagctggctggaattttcccccagaaaatgggtttttctttgctattacatcatcaggctgcaaatttctcaaacttttatggtgtgcttccttttgaattttcttccaccagatactctaaatcatctctctaattcacagttccacagatctctacggcagggacaaaatgccaccagcctctttgctaaagcatagcaagagtgacctttactccagtttctaacaagttcctcatctccatctcagaccaactcagcctggacgtcattgttcgtatcactataagcattttggtcaaagccattcaacaagtttctcagacgtcccaaactttcccacatctttctgtcttctgagccctccaagtctctaggaagttgcacattttcccacattttcctgtcttcttctgaggcctccaaactgttccaacctctgcctgttacccagttccaaagtcgcttccacattttcaggtatctgcagtagtgccacactactctcagtaccaactgactgtactaatctgttctcacactgctataaagaactgcctgagactgggtaatttgtaaaggaaacgggtttaattgacttacagttccacatgactggggaggcttcaggaaacttacaaacatggtggaaggggaagcaaacatgttcttcttcacatggcagcaggagagagaagtgcagagtggaggggaaaaagccccttataaaaccattagagctccagagaagtcactcactattattagaacagcatgggggaatctgttccatgatctaatcacctcccatgaggactttcccccaaaacgtggggattacaatttgcattacaattcaagttgagatttggttgaggacacagaaccagaccatatcaaagagtttgctttgacaaaaggaagtgtatctttttatttacttatttacaaagcagcttattaaagttattaaatagttttcaaaggggcagcttttttttctactttctgtattagtaagcaaccatctatgattgtaatacaactgaggtctcccaagagagaatgtagcacaaaacaaggtgtgctatctaaacctgtaagaaatgttgtgcagtgaaccaactccagcacagatatggagctctctcagaaacaacataggaaatttagatatgtgaaattcaaatagaaatagaaaactcaatttagagtttagtttgcgtaatatcttagaaatgttttcatggttcaaagctgatatttgacaattgtgttagatctataaaaattcacaaaacatccctataattttcagatacaaaatgctaataaggattttaaagttcaatgtggaccacagggcttctgcttttgcaggtgtaccttcatttacatcctttcagttgaggaagggtgggtgtttgagagcaaaatgtatgtataaggtaagaagaaaagagaaatgagagagagaagcagaagatagtgagccatcaataatgatattagttggcattcatttcaaaagccaaccaccccaatttagaggatttgcatttaggactaattaaattataagctaattgagcagggactgagttaagcctactgatagtgcttcataaatattcatattaacaataatacaagatgttccttttcaaggctaaaaactttttctaaatggtgtatacaacttgtgagtcttggtaagtcaatgttgttgcattcctgaatttttctatcccttttaaggataattctaactcaagtgaaccgaaattttccctgtagcagtagaggtcctctgaaaattgaggaagctctccatgtgtaatgctctgaaaatggcagacatttcagagtcacattctgtatatcattcatgtgaaatggcataggcaattttactcctcaagattctttgcccagaattcgcaatttaataagaacaagtattatgaattgttgaagattcttccagctctcttggaaataaagggtcttctcaaattgtagctttggtacattaatagttactctgggggcctaaatgagttagttaatgtgcagcttaaacatctgaggcacacccagaagtaactcaggactgaggaattcaccttcccttgctactcaattgccgtttgtgtaaaatagtggacagtgacactgtttgtgtgcagctagcaactgtctctaagtcttgggtttgttggagcataaagtgcactccagtgccctgagtatacctgtaagggtatttaccatgattcataagacttgttttaaaattcctctccaaataaacaccctcttaaatttaattttcctcatatttctatgtggttatttatagttcaagaacaagtatttaaaatatttaaatgatagccattcaattaactattccaaattttagtttttttcaccaaggagctgagctgattatcaaatatgctttatgtgaactctgttttgtttaaagtgtactgtattttttaaatttgtgaacatgggaaattatacaatgttctataataatttcaaacctgagttttttttaaatctcaatgaaagctgtaccttatctgaaatgtaaattagtgtaaaaaccctttcattctcaataattgtcggctactatctttttatcttcatgttcatcaatagtaaacattcaaccttcaacggttaacaaatattaagtgtttaccatgtaccagacacttttctacattctggggtgacagatctagaattacaagtgtatcaaatattataacagacaggtggaaggtgctacaggatcaaataagaagaggacataaacttaactgtagagatgggttggggagggaggaagaagttagtgttagaacaggcaacttttaaagaattaaccaggaagttatgcaatttggggtaaagtggggaaagagtgtcaggaaatgaggttgaaacagataatataagatttgctatttattcaaaaatagtttagaggccagtaattggctgggagaagaatggtgcacagatgggcaagtgttgacctgcaaggccaattagaaagctgtgtctataagtaaaggcaagagatgaggatgacctggattaggaaacaaaaaaatcctctcttttacctgcaaaaatagctgttgactttgtctcccttccatacaagacttggggtctccacgtttccagcaagagactgggcagttatacatctgtttttatttttactctgacctgactgctttatgcaagatgggccaagtctcccttatacatcaggaatgcactgatgtaaagacaagatatctgctcctccagccacctttcttccaggtctatctgccttaattcctcttcccccattctcagtggtgcatcattctctactgctgtcctagtcctgcctcagttttccattagttttattttgcagcagagattttttttttttttagtgatctcctattgttccttaatcacccttgaaatatacctaattaacccaagtaaaccttcatgatgcatgtctcttcatcctaggagtataaatgatccttgtatatctataggaacgtttctattccagtctttgaaattgaggaatttcatatacattatatatatatacacacatacagacacacacacacaacgtgtatatatgtgtatatatgtgtatatatgtatatgtgtgtgtgtatgtgtgcatatacatattccattagttatgaacagctcttttttatctcttaaaagcagcaaaataaaatattgacattattcagtgaattgatagttgaaatgtaaggatttcagaatgaaagttatgtagtaaatcctagccctttccgaatcctgatttcctaaatctaacctatatggaatttcttttttttttaataaaggttccatgaaacttggcctctttcctatcatcttaaatcgttctcctcttatacttctcttagttctacttctttcacgtgaaatccattctaatgtgaacctcggtttctctgagaggtgcctcaccacaatgcccatgcctttctgcacttcccacgtagatcttcttgccccaaatacctactgtgagccttctttcctctgtgcctttcattattccactcatctgaaattcagtcgcaccaactttttaagcacctttatcaggcactgtggtcagtaaggtttacagatgaataaggcatgattgccagtcactgacaacaaatttggggcagggagaacagccccatccccataaatggtctcatgtttcttttgtttgtttgtttgttttgatagaatctcactctgttgcccaggctggagtgcagtggtgtgatcttggctcaccataacctctgcctcccaggttcaagcaattctcctgccttagccttcgaagtagctgggactacaggtgctggccaccacacccagctaatttttttgtattatgagtagagatgaggtttaccatgttggccaggctggtctcaaactcctgacctcaagtgatccccccacctcagcctccaaaaaagctgggattacaggtgtgaggtaccgtgtcctgcccataaacagcctcatttataaaccataaatacataagtgctgagatagagatttgtgtgtgtgtgtgtgtatttggggggtggtggatacactttgcccaacaaatccaatattgtttactacttcctgtgcttcccacatgactgttctctcatctttctcttaaattaatggaaataccctcctaaccagttttccgactggtgcttttgcccatccagtctaatctcatagcagagttattctacaaaaacagtaattagttcacatcgtgttgctctctgctcaaagccatccaatggcatgccatctagagtcaaagtcaaattcttgctatgtctgttaaacttctacatgatctatgtctaccgcccctttcaagtgacctggatctgacatcttctcaaaccactgtccgcctcacccactcacttctccactctgacttcactggtgttccctgaatgtgccaagcatgttctgcatcacagcctttgcactacctgttcccagtgctgggaattctcttcctctaagtatctggatggctggttccatcctgcccttcagatcatcgctcatatgttactttagcagtaatcctttcctattcatgctttttcttccaccttgacgttccctgctgtatttttattcatagcacctatgacctactgtatcctttgttatctgtttattgactgctttcatccaacaagaatgtaagctctataagggcaagggcttttttctgttttttcactgttgtatcctctgtgcctagaatggtacctgtcacataataggtgctcaatgaatatttgctaaaggatggaaggaagaagggaagaggaggaaggagggagagagagaaagaggaaagttgaaagaagaaaggaagggaagaaagatggtagggaagaaggaaggacagcagaaagtctcatgttggctttactaagtctctaacacttattaacacctgctttgtcttataaacagagataacaccggcctgtagcctagtgcctttcgaaggcaacattatctggatagaaactaataaggttgttctgtttatgctgcatttatggcaagagttactgactttccatttatagttgtgatataaagtttcttctttaaatgaagacattttatttcagtttttaaaaaactagtctattacagaatttttaaaattaataatagtatataggggatgcagaaacaacaaaaatcatgatgtagaaatgtggatatggcagaatcatgaagctggtagtcgaatgcctgaattggggataagtgaccccttcagccatgaaacattccctgactattgccatcttcccctctttcattcctgttgtttattcgactcctgtacactatcatgggttgaactgaaaccatttggtattgctcactgttgttttgggtgttttagttctatcttcctaaattgatataagatccttgatgtgagtgctcatgtcctgcccccctcctcctgggcagccaccatagtgcacagcccagcactgacaaaacagaacattaaggatgtttgcttgttgtattcatcatgactcagctacacaataagacatgaggttaaatagtgtgcagacagtaaaaatactcgagcgtgctttatttttttttttagcaaaagaaatacaatagcaaacatcattttgccttgcaaactggcaaaatgaaatcactatttttgccactggtgtaaattttatacacacacacacacacacacacacacacaaacacacaagtacatacatatatacttattcaatctggtaggataaattaatcactaggacaaaaccatgagttaataggagccaaattccagcacatccaattggaatgcttgagaattaaacctgctaaaaatactgactggaataggaagacattcataaaacgattaggcacattttagtggaagtcagcaacaacaaataattaattgatttaactaataaatttagatatttaaattgtcaaggaattctttgttcttctgttttataaatggtattagcattatcttttttactggaaactttaaaggtgtaaaatactgtcaagagcaaaagcaacttagattgcctgtaatgaccattacattgacaccattttttgcagtatgatttgctattaaatgtgaataacgtgaagaacaataacactcctagatcacctgctatgaaccaggcactgctctaaatagctcaggtattttaactcatgtaactgctacaaccctatgaaatatatcctcctttcagcttcattttactagtgaggaaaccaaagctcaatgaggctctgttaagttaccccaggtcacacagctagtaagtgtctgagctgggtgttagtgcacagtgatctagcacccaagtccatatacttaaacactacctttgaatgctgctctgtaccctatataaggaagctgtggcccaaataggcaaacctgtgacaaacgaatcctagagtctaaaacaaaggttgaaaggtgactgtaaaagtaggcatttgatctttaaaaaccaggtgaatttgacctgccattcttgacggcattagtaaacattacatttcttataatttacattaaaaatctaatacttcgtttacaaaaaaagactttcaaagaatatgcatgcattttatgcaaggttaaagaagttttcagtgctggctagtgaaatgggggttagatgccctgtctatactacatgtttaatcaatgtaatcttaaaatgagatgaccttgtagccaagcattttttctttcctttataagcaatattaactatattaaatcaagaaagctaatagtttttcgtatttctcaataaccattaagttcaaacattggaagagtttaatattttacatgaaaaatccacaggcaataattttaagtgacttagaaaatatttaccgtattttaaccttaaatgactgtgtatgtgtgtgtgtgtgcctatgtgtgtgcctatgtatgtgtatgtatgtttataatctagtagttctcaaggagtattggagaaagaatatgtgatcacatgtagtttataaaagctctcgtgttttttgaaagacaaattttttgtcaatctagtggtaacatgatactaattttttaattaattttaatttccctgataatacatttaagccttaaaaatattgttagtgattcatgtttctttttctataaaaattatttctaagccttcctcaaatttcttccagactcttttttctgattgatttttaagaattttaaaaatattctgcaatttctcttgatcacaacaagtgttggaaatatcttctcccgaagaaaagaatgattcttaaaaaaatactttagtagcagtttttttctatgaaaaaattagaagtagctttttcttggcagcgttttcttctagagcaatagggaggaaaacagaaagctgtagactgttatcttcgtccatacatatgttagtgctggaactcaactccaaaaactttgttcctttgaaaatcatatccctccagaattggtggagtggtgatggtgtggtgttgaaggcctattgccaggactgagaaggaaaagctaaagaaagagggaaaaaaaatccagagaaagtgactgcctggggaggagggataggcaagagaccaaacatcgattctaaagggaatcttgcaaatgctctggcaagtctatgtatgggaacatcatttgcctagaagatgctcccctttactccctttttccctattgggctggtttagaggtcaataaacttaattattttacatctagtaatgtcccagatgatataaaatgtcattgttttcattctatcatatagttcatgaatcacagttaaaataatgtttcccttctaaaaatttttcaagttttttatttcaccgtaaagttcttttacatatggaattgaattctgtgtgcagtgtgagaagaaatccacttttgtatgtttcccatatggctaactagttatttccacaccatcgattgactgatccatcatttttccactgactggtagtgttacctttgacacgcatcagtacagttggtctgctttacctttctagctataattgtggcgtatccctctattaattgcctcctttagtgttattcagtgcattttatacattttgttacgaagatcttatacattttttattcacatccactgtagacttctgttgctattacaaaatggcaacaattttcagttatattttccaaatgcttgctgcagctatatccaaatctaataatttttatatcgaacaaatatttagaaacttttcaaactttgatgtacttttaatgatgtttcttctgattcttttaggtattctttgtagacaatcgtatcatctgtgaataacaaaaatttgtttcttccattccaatttttatactctatattttataccactttttaaaatgatttattgactggctgcacggatgcttctctgactttaaaatatgaatccctgagggatccttttaaaaggaagatcttggttcagtggtaggtcaggcactgagaacctgcatttctaacaagctcccaggtgacagtgaggacacttgtccaaaaaaagcaatgctttcaaaagactgttaaatagaaatggagagaacaagcattctttacttgtgtctacaattaaagagcatgcttccacatttcaccatcaagattagatatctttgattagttttggtaacttcctcctattccaaatttgccatacatttttatcgtgaatggttgtttagttgaataattttctgtggtttttcccctttaatctcttaacattgtgaattattagaacatctcatgtttaaagcctttcatgccatatgcacacaaatatacatacacatataggtacatagaaaaatatgtatttattgctgctttatttgctaacatttggtttagactttttaacctgtctttatgattcagattggcttcatgtaatccttgaggattcttaatgtttttaagtttcattatagaatgaattaggtgtataccctcttattctaagctctttacatggaactcacttttatactagtttttgagacacactctgttataatcagcatcttactgatgaagaaacagaggtacatggaggttaaataactagcccaaagtcacatagctagtaagtgataaaattcgttggtttttgtctgttgaacaatgaagagaatggtttcctaaaatttgttttgtttagtcactgattcactagttcaatcttaaatgtaattcagtagttcagtcctagaaacagttttcaaagccactaaaaacagatttagatcctagtgaggtaaaaataaataaataaataaaatgattttgaggccactgagaaaagtggggcccctagtaatttgtaacagcctcccactccctatcaagaggaggtggtagaccgagattctaaattgaaaaatgaaggccgggtgcggtggctcacgcctgtaatcccagtgctttgggaggccgaggcgggtggatcacaaaatcaggagatcgagaccatcctggctaacacggtgaaaccctgtctctactaaaaatacgaaaaattagctgggcgtggtggcgggcgcctgtagtcccagctactcgggaggctgaggcaggagaatggtgtgaacccgggaggcggagcatgcagtgagccgagatcgcaccactgcactccagcctgagcgacagagcaagactctgtctcaaaaaaaaaaaaaaagaaaaatgtaaacacttaccttggctttgtcacttaatggcctatgtcaaaagcttaatttgcttcatgatttcatttaaagtgtatacctttcactgaattctgcagtgatttagcataattcactaataggtatatgcctatcattttcataacctttcaggaaatcatttggccctagtatactgactttcgctctaagttttcctttatacctgaatctcaatctctcttactgagatttaaacctgtatctttacagcgaacttcagaaacatgggaaagactgtcattatccttcatgaaatcctgtggtccacaatgaagcgtgtttattttgttaccactcagtttgatttctttcacattgtttcatggtttttcttaaattcttacttactctttagcatgtggaagtactgcctttcaatgtaagacattttactttaacaattcaaagagatttttttttctatgctacgtagatattagggtacagaagaaaatacaggagacattagcctgctcatgaaggttatgaactgcacaaatcatgtagtcttttacaggtttaattgcctcatttgtgaaaggaggttgaactaggcagtctctcacctctctgtcagctctgatgttaaaggattttgttcatccttacaatgttttctcattaaagctcaaatatgcataattaatgtaatgcattattttttaggagattgaaaacctatcatctagatgatgtgctaacctgatttttgtcaatatcattcttgattctgtttttatatctcaatatgatacagagttgcaaaatatttctaagctttgatcattcttttgggcatattcctgtagataattttgaaatgatatatttagtggagaaaatgtaaaaataatattaaatccttctaagaaaaaacaaatgtattaataattaaatagctgcactgtaaaccaatattcactattcaatcattgattaccaaaaagatagcggcatgaaaaacctctatatttttatctcatggtttaagatgaatattttgcccttcatatttatcattttttaaaaaagaacacatttagactttgaaaacgatatgtaatgtgcttctacattaatgggaaaaacaacctaaactgtatagtcaaataaaatattggaatcttataccttgacatatttttttaaactagacatcatctaatttcttttcaaaaatagaaataactttttatctttgtccttggtattactttatacttgtctgttcagtggcattgctattctgtgataagattttattacagaaaatgtctctatctgtacttgaacattagtctaattttttttacaaatgttccttgatttgacatctgtcaactgatttctgagttaatattatcttttcagtttccattcctttgaaataggaaatccaatattaaacccttcaataaagatgaaccctacatctgtatatccagaattttggtttgataaaaccaaaactgataagttcaatggggttaaacattcttgaagtaaaattggagagacatttgaacacctttaccccaagttcattcatctattcatcttctctttaattaagtctgtttgaaaaaagctttcattgattgttagcttcctggaatatgtcctaaatatcataaggcatatggagctccatgactcctcagaaaagagcacgttgattgatcagtgattctgcattagacatgcgtgctacaagtttgatttgactgacccagagaggaatataaccttaatggaaacagagaaaatatcttcatgtcacttggcttagcctgctcctttcaggggataagttgccacagcattcaaaagggtgtagtctatgaatatttttagaatctctaaagatgaggattttacaacatggtattcaacagcagagtttaatttttcttttttctcacttaacactgagtcattaacagttgagacattttacatgactgtgagcagttgagcacaaaaaccagatgttaagattgggtacagtcaaaagtttagacatccacacctgtgttatgttttgtttatgttctggagcgccaaactttgttacatctttgaacccacttcagacctcaaattaccacattttttaaaagcctcattagaatggtatcatatagtgctgaatccatagaacagaaattcagtgttttcagattgctaatcatgtatgaaagtttctgaaatcatattgtccaacgggctgtaacttggcctattcttctatctcctaaggaaattgaattgactggacactgttcattataaagatacagcaggtacttccttgtaacctgtgctcttctatatattttgaaaattattattcattttcatatttatcaaagtgaaaaaagcaacatagctactctacttatatagctcattttaaggaattttatacttgttttctagttttgtgaatttcttatgaattcacaaaaataatgtaaaagctaatggtctgtccctgctaccattgtgcatattagtcaacaagtacaagtagaatatttaaaagatttattagttcctaattatatatagaaaaagactttgaaaattacttaagccatgattctaccaagatgtaaccacttttattttcttttttccttcccaatgttgactggttatatgcatattaatggagctataataataattgtatactttttatcttactttctaaaccacattattattccttaaatattgctctttcttctgacacagtcttctcatgtatcattttgattactacataatattctgacttaatcgaaactttttgtattttttgatgttcaagcttcttttctcatttgttactattagaaatgatggctctagaaacatccttagaagttttccttatcttttaaattaaactgcttttattttactaaaataatctttaagaactgggattactaggtcaaattctacaatcatatttgtgtcccctgtcattttgtaaccaaaaagatgctatttgagtaagacctgcttgataacttacttattaatcttattttattttgtcttgcatcacaaatgagtcaaattctatttttctctaattaaatcttacgatcaccggtacttggatttaagttttacagtgaaacagaaagaattttaaaaaacggtttaagtaggagaaattatattttcagatctccttgcctatctgctggaatcactagtgccaccacttttcactggtgctccttttgcttcacttaactaaagagttttcactcagacccttatgatttctccaagatgcattacattttcctgctgtttccatatacctgggaaatagttctttcatttacatcttctgtctctatatttttccaggtaagtcatgcctcctttaaatttttactattttttatctatgtctgtctatctctactaagatgttctctacctttgtttctgtctacctaactagctagctacctacctacctatctggaactctacctctgtctcttatactatgcccattcttctcttttctctttaaaatttttttgttgctgttttctcttttcctctatttctgtatctcgtttgtgtcaaattgccagactacttaattagtatattcatgtttgtttttgaatttctattactgtattttctcttattagtatttgtttttataattattattttcctttacttttttgtgtttattttcctattttttctaagtaagttgctttgtgcattgagttttagcctttatttctaatacagtgatttaattctattgctttagtgacaatcccatatatttgatgcataatatatttattattaagttttaagtattttataaatccctttgatttcttctctcactcaagtgttatttagaagtactttttaaatgttttccaaaggaatgagtttttaaataaatacattgttattaatttctaattttgttcatctttaacagaagagatatttgtatagtacctattctttgacattgttgaaactaaactgaaaatattagttaattcatgaacactggattaattataattataatattcaaaaaatataattatattcaaaagtataattatatataagtttatataatttataaagtttataatataaacctatattttatatatttataacttaatataaaattataaagtttataatataattataatattcaaaaatattaatttaggcttcctatttatcctgctttctaatgtttgttttcttttcacgtcttttctggcattattttagatcaaagtgatttcctcccttttctcattgtatttttccttctagtttgtaagttttaaactctaattctattattttaataataaccctaaaaaattttccaaatatgtaacttaaggctgaagttaaataatatctttacccttttactgtcctcctgagaaaatacaaaagaatagatttttgttctcttcatatttgtattacattgtagacattatcattattattatagttgtagtaagtcatctttggtgaacattttctaacacattttccattttctttgctcagcattttttttttttttgcatctgagaccatcctttttatttaaaaatgtcttttagaagtttctctagtgactctccaatagtagggaattctcttcatgtgtggttttcttactatcttattttgtgcttagacttggaaggtagttttgttgtgtatgcattactgggttgacaactacttctcttcacctctttaaatacgatactaccttgtcttttgagaaatcacttttcagtctgaccagtgttacttttttctttttgggtgctttgaaattcttatttttatctttgttgttgtgcaatttcactctaatgaatccagaagttgagtttttcaaaagtttacttaaaatgtattggtattcctaaatatgagtgttggtgtcttttatttattttggaaaattcttagctattattgtttcaaatattgcctcgttgccattccttttaatctatcccaaccctagtaagacttatgttggccccactctgtcattcacctatcttaaccttgctttcatattttccacttctttttctactgcattctgaatgtttcattcatatatgttttctggctcactaattcaaccttcagtagagtctaatttgttgtttcacctgtttgttgagtttctaatttcagttattagacattcaattttagaagttctattggtctttattctaaatatgtgtgttgatttttattgtcttttgctcatttactaaattttttatcatttctttaaacagcttaaatatttttttttattttagttccttgatagttccaatatctgtaatcttgttggtctacctgtgcagtttattccactgattgtctctcaggcaagtttattttttttatgcattttctatatttttttacatatgtgagctcatactctttagtattttatctctggaaattatctgtgttgaaagtgtatttttcgaaagaggatttgcttataatttaagtaactgcatgtctgctaactatagatttactttaaatgaaatgttcaacttttgggccacgcaaatatccaatgccatattacatatcgcaagtatacacttgtgattagaaatttttgaaagaaatatttgttttaaatatgctgcctgaaaccaagacaagtcttgttctgcatgaaagattgtagcatgcctagttataggtattgacttttgggtataagactttctgtgaagtctgaatgtgagttctttctctgtttaggccccttgtttagattcttgccctggaacccaaagaattggtaaatgccttcaggaaaaaaacaaaaaaacaaacaaagcaaaaaacaattctagtacttagttatccctgtgggaccaagctttcttaatttcaagcctcaaaaacttttaatttaatgatttaaagcaatcatccagtataattttagagcaaattttgttgaattataccataagaggaaaaagcacacaaacctaaatgtaaaatgtggtaaatttccatgaagataacatacccatgtaagcagcaattagattaataggcagtatattgctaagctgtagaagcccccatttgtgtacctttcagattctgcccccaccccagagtaactactattgtgatttctaagataatattcatattatttaccaaagagagtgtgttctttgttctctagcttcttttcctcaacactgtatttggaaaagttatctttcttttttcttttcttttctttttttttttttttttttgagacagggtattgctctgtcacccaggctgtagtacagtaccatagtcataactcattgcagcctcaaactcctgggctcaagcagtcctcctgcctcagcctcccaagtagctaggactacagacatatgacaccacacctggctaattttattttatttttttgtatagactgggtctcgctttgttgcccaggctagactcaaactcctgggcctaaaggaacatttgtctttatatatgtagttgtagttcattttcatcttcatacaaatatgttataaattatttattcattttattgttttgttttgttttgttttgttttgtttgagaaagagttccactgctttgcccaggctggagtgcagtggcacgaactcgtctcactgcagcctctgcctccagggttcaagcaattctcctgcctcagcctcctaagtagttgggtctacaggcacctgccactacacacggctaatttttgtatttttagtagagatggggttttgccattttggccgggctggtcacgaactcctcatctcaaatgatccacctgcctcagtctgccaaagtgctgggattacaggtgtgagccactgtgcctggcccattttattattggtaaatatttgttttatttttatttgaaactattacaaatcatgctgctatgaacattactgtatacatctttttgtataatgcatatatatttctgatgggtatatagccagaagtggaattgcttgattatgaggcatgcattttttgaagactgacagacagttttctcaagtagcttcttcaatttagattccaaccaatattctctattttctaagagctccacattcttgtcaacacttcgtattatctttttcattttaaccattctagttgagtaatatgtagtgttatttcattgtaattttaattttcacttcactgatgtctagtgattctgtgcattaatttttttttctggacttttgaagtgttctgtatgggaaactattcctccatttagctagctattttgctggaaattattgtataaaatatcatctcataatttaacagtatattccttcttctcttcaaatttttattaaaataatttttcagtactcttgaagtcaacttttaatttgtccaacctgtctttgagctccccctgctgttttctatttaaactatatacctgttgattatgcataattttctttaaaatgatggattcttagccaataagctattttaagcagaagcattttttttgccaaagactaagggtataaaataaatttaaatgctaactcaggatataagaattattaaaattaatgcttgaaaactagtatgttacatatgggaaatctgtataccttcataatttcactgtgaatctcactcctctaaaaaatgaagtcttgaaaagttagtattttaaaatacttaccttacttgtaatgtgaaaccatttatattaatttagcaaatcaatgtttcaaattattaacaactagacaaactactgagccatatgttaggtatattgtaagcatgttgaagtcaacaacatgacttctacactttctactttctcacggttcccagaatatctattttgacataattattgaaaaaaaattaaaagcatttattccattgtcttgctacatctaaattcatggtgttatgtttctttagggcaatggagctgaaatgaataatggataccatgtagtgtttttatatatttcatctatgagctatgacagatatctccctacattccagcagaaaaaaaaatgtgcttctttcctaagcttgccagctataaaggcctattagacattcagagattatcaggaagcaaaaagcttcatagtcttaacaacgtaaatctgaagtcttagaatgagttcattagaatatagacattgaatatgaggtaagtctgagttgaaattctatctctgacaactgctggatctgtttttggtttccaatagtaaaatggcactaataatgatatatgcaaaatgtaaaatgcttagcacagtgcttggcacatagtagattctaagctgtagtttaaacagctattgtgctatgaataagccatacgttgacattttccctcttgagaatgtgctatttaagtgtagaaaacctgctttcccctgtccgtgtgaatttccttaacattcatcttggaaatgataccacatacccttatattgatgcactgcaagaggccaatctaatgtaggcataaaaagagtaatctggtaatctgctcttctcagcaccctctgctaataatgctgtttgaacaaattctagaaagactgttgatgccagagccaactcagaattaggcaggtgaatgttttcaacttctgctaataataacatcagttctgtactctcctctgggttctttttgctgtattaaagctgcagttcccttaggttagcttctatgcataacctgggaatgcatattttagctttttacttccctcccaaagaaaggagcagaagaggagaaccaaatagccaagatctagaagatgaaactgttgtatccattgtgtggattcagataagcctccacccaaaatatggttcaaatgttaagactaatgagcagccctacacttctctctctctcactttcacacacacacatacacaaacacacgcgcacgcacacacacacacacacacacacacacacacacacacatatacccctaccaagaaagtatgaaagtatgtattacttataaaattatgaggtttttctggggagagcagagcaggcctcccaagaaggtctgaagtagcttgagagagcagggggaaaatgactggtttgagattttatgacttttagtgggtgaggccatgctgagagttttgtgtgggtggactctggtgtggtttgaatttcccaccatcaccaaaggagagaacacatgggctttcttaacagttttcccaaatgtaggacagaggggaagagagaggtataacactttaaagctatcagcaatgacacatcaaaaaatggacatagattttttattacagaaattaaattgtatgagaacagaaatgaatcccggtgctacacagctgatgtttcctaggaatgagaactagggtaacttttttaaagcacgtgtttatattgattggtacatactagttagccaaatttaactgggttgagatggtggactttccttttgaacctcagttatgcaaattgtaagaattgtgtttccttcaaattactcaaaataatattgaatttcttacaaatgcaaaatgaattgtggcttaatgtgcatatgtatataacagatactttgttcaactatattatgaaatactatagtatgtaactttcttaaataaacaggatgacaaatcagtgttaggattcaaatgggccctatattactctgtatctctcataggccaagtgttaattctggtacacatgacatttagcacatgctattacatttattgattgcatatttttatctgttatcttttggttcattctacaaggattcttcaaaagaaatcaagtaatcctagaccccaatatataaaagaaaccaactcatcctagacccaatatataaaagtaaatgacattttgttcttgtcttaataagttcacagtatttcaggaaacatgggaatacagaataacagataagaaatattataagacttctagtagagaaatatgcttaaaatcatatgtatgttcctttacacctaagaacctttagatataaatgcattttaactgttctggagagttccaactccaaaatagcctttgttcatatcaagaaagtaaaccaccttctatttcaggtgggcttactcaccatacctggggccacattactgtcccagctcactgaaaggtcataatccaggatgaaaccaaacttgaaaattatagtgaaacacagtagaataatttagaagcatatactttgatgtttttagaaagtaaggaaataaaactttaattgaacttggaataaactcagttctgagcattccattctactctgcagttgtcatttatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcacttccattgaataaagctgcctctggatagccatgagttgcatgaagttattttactaattttatttgccttttacttgaaagcataagtttctgaggatgtaattacagtttcccctatatttctacagaagtagttatagatgatggacctcctgaacttttatcactttgccatactctgtaaaattacctaagagctccagagcatgaaattaacactcaggaatattgtagcctaaccttttttgctactctgaataatactgaattgaagggtcttccacagcaagccctctttaaattatgctttctgatgctttacctaaggctatacacttgtctttagattcttctagattattttctcctaatacagaacttagcatttaaatgacaattttaaaaattgagatcaactcttcaaaagaaatcaagtaaaagcaatttcagcaaaaaaaaaaaaaaagccttctaatctcctacaaaacacctctatcctatcaagatattgtgattgagaattagaaatagtgtggaatcagatgttagtttgtcctttccttttcactggaatttctccatgctttaatttttatatcaagaaaaacaattcttgcaatattccctaaggagagttttacaaaaaaagagataaaacaaactacacacacacacacacacacacacacacacacacacacacacacacactaccttaaggaataaagaaattatctgagtggaaaataatggtgctttcaattttcctaattgaattaaaataattatctaagtctttttgatcttgtcccaaagtgaataaaatgtctttttttaaatttatgtttcattagatatatctccatcttttcagtattcaccccaagttttaattgggtagaagaatatggaagaaattcctattgctcagacaccatgtttaaagctttctgaatgtgatctaatacctccattggttggaggtaattaaacagagatctgttcttttaaacaactatttgagtgctttaaatctgaaagtcatgtcataaatgtcagacctctttctctttgctttaatcatctcagaaagacttatctgttaatggaacatctgcatataggtattttgttgaccacaggtgttccacataagtttaatctacctattagttatatgttcatgctattgaggacctttcaataataaactttactgagtgcttactctcttctaagagtaatgcactatgctaggagacaggagggatataaaggtaaagaaaccatggcatgaatctttagggagattataatttagtggagaacactagtgaaaggaggcaaaggaattaatagaacaagacagtttctctgagtctccaaaggcactgtaaaaattcctggggaaactgcaagcaagagcaaaatgttagctatcataaacattctcatgcatcttcaggttttatcttcatccataaatttacccattaaatttagacattctactatctattccacttgacattccaattagcagctcagcctcagcctatcaatatgaatgcacatcgcttccctgttctcttgctgtgccagtctttccccagtgtagttaggtagtgtctccaatcagtcaccatcaccatactgtgctgattttatattctgaatattttttaagctttttcctttttatcaattgactacactagtttagatcttcatcatattattgtacacaactgctgggttttttctgtctggaaagtctattttcctctttcctccccagctgcctctttcttctgcctctggatgcatttcctcattttcctgccttccaagatgtatttaatacattcctctgtgctctcatatgctgatacatgtctgtcgctgtatttgctgtgtaatatccaaattatttgtgcatgtctttgtttttctccaaaagttgcaagctccttaaggtcaggagctgttctttaatatatctactctacctagtgtagtcatgcttaatatttgttgaagtaaacaaatctgaaccccaaatgtattatgtaatctccatatcccagcacagataaaggatatgctcttgaattgttttattgggagaaaacagctgacagattaggctacacaacaactaaaaactaagaaatgactacatgataaattgtaatgaaaatcggaaggcagactgactgaggaatatatctctaacaagtattcaaagatataattttgttattgttaaaaagaatacaatgaatggagagagggtttggatttcacattcaggacttctgaagaccaagtataagagattcaaaagtgataatgtgaatctgattagaaaattcaattttggaatttaaataagaaaaaaattagttggtctagcaggtgaggctataatatggaaaaatgagaaagggatacagcactgaaagtgaaaatgtggaaagagagaagatcagaaggggagaaaaaaagaagaaataaagggttagagtttatgaactgtaccaaaagaaatgatacaatggccagtcctgtgagggtagtagagggatctctttattgtattttcttattttatttttattttagattcagggagtacacgtgcaggcttgttacatgggtaaattgcgtgaagctgaggtttgggcttgtaatgatcccactgcccacgtagtgacataggaccatagggagtttttcaacacttgctcacctccctcctcccacccttttggaatcctcagttgttcagtgtttccatatttgtgtccgtgttgcctccagtgtttagctcccacttataagtaagaacatgtggtatttggttttctgtttctgtttcaattcactgagaataatggcctccagttccatccatgttgctgcaaggaacatgatttcatctttttatggctgtatagtatttcctggtatatatgtagcacattttctttatccagcccaccattggtgggcatatgggttgattccatgtcattgctcttgtgaatagtgctgtgattcacatataagtgcaggtgtctttttggtagaatggtttattttcctttgggtatacactcagcagtgagattgcagggtcaaatggtggttctattattagttcttgagaaatctccaaactgttttccacagtggctgaactaatttgcattcctgccaacagtgtgcaagcgttcccttttctccacagtctcaccaacatctgttactttttgatttttttaatatactagccattctgagtggtgtgagatagtatctcattggttgagtgtggtttgctaatattttgtggaggacttttgcatctgttcatcagagagatattggcatgtagggtttttgttgttgtgtctttgccagattttggtatcagaaagatactggttttgaattaggagttcctcctccttgatttttttttttttttgaatactttcagtagtatctgtatcagctcttatttgtatgtctggtagaattcagctgtgaatccatttggttcagggctatttttggacattaggttttttattactgattcaatttcattacttgttattggtctgttcaggatttcagtttcttcctggtttaatcttgggaggttgtgtgtgtccagaaatttatgcatctcctctaggttttctagtttttgtgcatagagatgtacatagtagtctctgaggatcttttatgtttctatgggattggttgtgatgtcacttttgtcatttctgattgtgcatattcagatcttctctcttttcttgttaatctagctagcagtatatcaatctttttttatcctttccaagaacaaacttctcattttgtatatcctttgtatagttgttatgggtctcaatttcatttaattctgttctgattttagttatttcttttttttctgctagctctaggtttagttttgttcttgtttttctgttttttttttttttttaggtgcgattttaggttgttaatttcagatgtatcttcttgatgtagacattcagtgctagaaactttcctcttaacgctgccattgctgtactctagaggttttggtatgttgtatctctatttttgtttgtttcaaataacagtttgacttctgccttaattttttgtttattttagagtcattcagaaacaagttgattagtttcctgtatttgtgtggttttaagaattcctcttgctgttgatttctgttttttttccactgtggtctgagaagatgcttggtatgattctgattttttgaaatgtattaagacttgctttatgactatgtgttcaatcttggaatatatatcatgtgcagatgagaagaatgcatattctgtagttgttgggtggagtattctatagatgtctattaggtccaattggccaactatcaaatttattaaatacaaaattttttgttagttttttgcctgtctattgctttcactcgtgtgctgaagttccccactattattgggtggccatgaaagtcttttcataggtctataagcaattattttataaatatgtatcctccaatgttgaacatatatatatttaggatagttaagtcttcttattgaattgaacactttatcattatgtaatgcctttcttggtccttttttactgttgttgtttaatgtctattttttctgatattagaatagtgatccttgttctttttttgtttcctatttgcatgatagatctttctctatccatttacttgcagcctagcctatgggtgccattacaagtgaaatgggtatcttgaagttagacttgtttttagtctaatttgccactttttgccttttaaatggagtgttaaaacactatgacaggaataaaaccttacatatcaatattaactttgcatggccaaagttaatattttatgttaaaacactatggcaagaataaaacctcacatatcaatattaattttgactatgcaaaagttaatattgatatgtgaggttttattcttgccatagtgttattatctggttgctttgtagtattgattcagtcactgcttagggcctgtgggctatctgcttgcatgtgctttcatggtaacaaggatcatcctttccttttgttttcatgtttagaactctcttaagtatctcttgtaggtctagtgtggtggtgatggattcttttagcaattgcttatctgagaaagaatttatttctctttcatttatgaagtatagttggtgggatatgaaattattggttggcattttttttctttaaaaatgctaaaaatagtcccccaatctcttctggcttgtatggtttctgctgagaagcctgctgttagtctgatgggtttccctttatagatgatatgactgttttctctagctgccgttaagtttttttctttcacgttgaccttggatagtctgatgattgtgtgccttgaagatggtcatattatatagtattcttccaggaattctctggatttcttgtatgtgcatgttgacttctctggcaagattgaggaaatttccctgaattatatcctcaaatatgtgttccaagttgcttagtttctcttatctcagaaatgccaatgtcactttacataaccccatatttattgaaggttttattaattgtttaaaattatttttttctttatttttgcctgcctgggttgattcagaaagctagtcttcgagccctgaaattcattcttctgcttggtatagtctgttgttaaggcttccaactgtattttgaaattcccatagttaatttttcaattccagaagttgtgtttggttctttcttaatatagctatgttgtctttcaaatcttggatcatttttctggcttctttgtgttggatttcaactttctcttggatctcattgagtttctttgccatctagattctgaattctatatctgtcatttcagacatttcattctggttagggttcattgcttgggagctagtgagattctctggaggtggtaaaacactctgacattttgtattgccagagttcttgtgctggttccttctcatctgagagagctgatgcttttttcttttcttttttgaatttgctattgtttggatggagcttgttgattttaaattcttttttcccttgtgggtatgactgtggtgtaaaatgtgtatgggtggatcagcttcatttctgagtgctttcagggcgccaaggctctgtatgggttccttggttgcagataagtttgtgcggtggctgagacgttgcttcttgtagtgatgtaattttgttttgtagtgtaattcaggctgcagcccagtaggtggcacttaagagtgagcgccagaaggtaggggcaagggcagaagcaatggaaaagtctgcaaagtgccctccttcagcgcgtttgccttcagtgggagtggaattgctggagaagccccaaaagtggtctctttcagcccacactctctcggttccgctggggagagccaccttcgagtccgcaacagtacactgaagagggatgagagaggtgagcgatgaccccttctcgacaaccattccctggctttggtggcgcccccttcagtggctagcgcagtgctcctgtttcctttgacccaacctttgacccaagaggggctttagccggctacatccccctcccttaggggccgactgaaccgagggctagatttctaggggagtgggtcccttcccttaccacttttcagagctggtgggttactgtcccccaactgaacaaggaagccgactggggaacccagtagttgatatgtaagggatgctgggaagtgctgggtaaagaagggtgagtccctggcgagggctccacccccaggcctgtgcccacggacctaggtgaggacaggcactccagcctttgggcccaaatgttgcatttcccaagaccaacctagcctaccatgccccctaccatcctgtgcctataaaaaccccaagaccctagcgggtagagacacaagcagctgaaagtggagaggacatcgaggggagcacgctggtggaagagcacaccaacagatgctgccacctggcaggccgtccagcagaggaatgacgcggagtttggtcgtggcagtcataggagagcccgggctgctgagcggctggactccagggggaaaccatctcccttctggctcccccatctgctgatagctacttccactcagtaaaaccttgtactcattctccaagcccaggtgtgattcaattcttccctcacgccaaggcaagaacccgggatacagaaagccctcgtccttgtgataaggtggagggtctaattgagctggttaacacaagctgcctatagacggcaaaactgaaagagcccatggtagcacatgcccactggggctttgggagctgtaaacatccacccctagatgctgccgtgggatcgacccccacaacctgcatgctcccctagaggtacgagcagcagggcactgaagaagcgagccacttctccagttgcacaccttgcaagggggacaagggaacctttctcatttcgtagcaacacacgcagactggttccaggtctcaaagctgcccctagctgcatgtcttgccacccagaagaaacctggcttcgggaactctcctgcccctgcagtcttctaatgctttatgtctcttctctatcgcatccaagcattctctcctagactatctgctcagaaggtgtccacttactattctggcgtttctctgttggggagccacacactacctgcttctgctcagccatcttgatccctttcatgtctctatttatgaaggatgaaaatggaatggagacatggagattgaggattgatgatgaggcttgttgaaatttgatgataatttcactaagaaacttagaaacagggccagggggtaataaatgagagacacaaagagaatggagtaagtagatatgatggacttgcaaagaaaaaaccttgttgaagagcagacgtgagctaatggactaagagaagcatgcaagtggggagactacttctgatagtaaacattttggaagagtgtgccatcaggagaaagcccgacttcagtgtggtcaaggagctgagcaagttatatccagaagtgatcaaggatatttgtgagtttgcttacaatatcataaaggcaggacaagactcaaggaagattcctagggaggaaactggtggggaagtcaaggccaaactgggctggataaggtagaaagagcatattgatgaaaataacagccttaggtgggaattgtagggggtaacttgaaggggatttgaatacaggagcctgtgttaaaaactagctttttcttttcttgctttttttcttagaaatgtatagaacacatccatttattccaacactccaagtgaggaataaggtttgggctcagcttgtagtccgcaccaatcactgagtattattttgaggggcatgtttacggggaaggtacgttgctggtgggattgtttcaaagtcttaatgcaagtgcctcaggtctattgctagacatttagaattttcttggttttttgaaagagaaagattagggatagttaatagtagtttaaaagactgtgcaaccttagtaacatttctttgcaataattaattaaaatcacaaggaaaatttttgcaaaagtttgggcatataaaataaatgaaagttatgactaacagttcaactttctcctgatgtctcacttttgtgagaactgatgtagaccagaaaataaatttctaggtgttttttgtttgtttgtttgttttgttttgttttgtttgcttaggttgacagatctaattttcatgtcaaattaggacactgactttccctaacagatgttcaggagctgaatttgtatcctaattctagtcttgctagtatttatttttgagacctgcaatccatcattatactaacatggcaatgcctaggaagtttaatggctatacgacttctagaaagtgcctttattacatatctgacacattgcaaattcacaagtggagtacaaacaatttcagcagcttagatgacattttccttcctgccagtggtctgaactcaccaggtagcaacacccaaagcattacattctgtctccctgagttgcattgtatttttgatatcacagcataaactgtcaaaggaagtatttctctaattttaattggggttactagggtcaaagccaagtttccaaagctcattttgtttttatcttattatcatgcatttatagtaagccatttattttttgaagcaatccttattataacttggaaaaaaactatttcgtaatgtggtcagatgtgattagatcactgttttatgctcagacgtatgttccaccttttcccataatgctgtgacatttggggtttgtatagcttcatgaatcgaacttaaacagtaatgcattttcacaaataaatagaatcactcttcctacctattatgatggatcttaaaatatcctgccacatctctctcgttattcattcagtttctgatcttagtaatttacctatacattaaaacattgtaattatgtatttaaatcaccaggacacctatcatttggtctctaaaactgagttgctggttgttagagaaaaatgtatttaacttgtatttatgaatataactggatgagattctggttatttaataggcagtttaacttgagaaacagagtagatgggaaaaatgagaacttactgtgctttaacaactttacattaatttgttggttcattgtgagctagtttattacagtatattgaactgtttaccaaatagtaaactcgattccagtgtttagaacatgcttttttaaaatgacattcttaaccattttgccttattgcaaggcatttacgtatatacattgagaagctgtatctgatcatgtttctgcagagatgtgttatgaactgctttagtacacggatttttgaatcttaacaaaggattttggccacctgcaaaataagaggttttcattctttttagaatagtcttttttctgggtccccagtgtatattttgccaaaatgcctaaaatattgcaataaaaaaactcagagtttggtaccaatctgacaattaatttttttaagcctttaaaagtatataaacaattttagccaatggacacctctcactgaattgaccatatagatcatattagtccattttcacactgctgataaagacacccttgacactaggaagaaaaagaggtttaagggactcagttccacatggctggggagacctcacaatcatggcaaaaggcaaggaggagcaagtcgcgtcttatatggatggtggcaggcaaaaagagagagcttgtgcaggggaactcctctttataaaaccatcagatcttgtgagacttattcactatcatgagaacagcacgagaaagacccaccccataattcgattgcctcccaggacacatgggaattgtgggagctacaatccaagatgagatttgggtggggacacagcctaaacatataatagacctatcagttccctacactaataaacttccctggtattatttccacagcacatgtaccctggaaaattagctccaggtgatgagaaattcagttgagggcagtaaaaaagaaaccaggtattctcacactaatttgagggtttaatctcactgggcctcctgtttgtttttagtgcattggaggaaaattagattttctgagtaaatagaaatgagcaatgttcctatgtatatacacttaactcttcaaaaagaacaacataggtctgtactggcacaagtaaaatgttgtagaaattgggtcaggtgccaagtgtgagcaacctcactctccctaatcagacagcatttcttatattatttctggattaatataagtaggtaatcttgaataaattctctagtgaatgttctacatcatttattgtcagtgaatgtacagatgggatagtcccagtaaatttttttagaaaaccaaaccatgttcaggatcatggatacttgtattcaaggttttcatgggcattcaaggaagaaagaggtgatgcaacatgccgtaagccagattctctagaaaacagacttggaggcagagatttaggcccaagaaatttgtttgggggtggggttctcttaagatcaacacctgtgtgcagtagatttctctctctttggataaaggcaattccaggagagagacttagctgagaagactcccagctgctgggggaatgaatgcctcaatcctgaatgggtatctgggttgcatatttgagcaaaacatcctaactttagtaaataaagctacagctttttcttatttctcctatctgcttcttgcctgggcaacctaaaatttatccattatccctgctatctcaccaggaagagtatagcgataaagagcaatttctatatcttatacattatatttaactataacatttattgttattagatagttagattaagtaagaaataaggtattcatgattcttttgaatctgtgtgaatatacatatagttaaatagtgacattgaaagtatggtgaatttttatatcatctttctggagaaatactgaggaaaatacttgaattttgcataaccaaggcatcagttactattcacaatgagactacagagaaagctttccaaaatgtttaaatgaaatatgctttcaatgttatgtggttttcctgtgatgtagctacttaattagcattgtatcaatcaccactgacatcaaatatgataacttgctttactggaaagtcactgctcaatctcatgaatgaaattgatgaggtagaaggtaatggtgcattgccaagaaaacaagaaagaagggagctaaaaattgagagttacctactttgcagtatctgctttatatatggtatctgatttcagtttatctgaaccctcccctggaagtagctattatcaactttatgttatttacttactcattttattctttttaaaaagaataatgagatgttttaaacatagagaaaagtgcacagggcaatataaaatcacatacataatcatctcccaagagtaactaatgtcattataggtaaagtttgcttcatatcattttaaatataaatattgcagatatgcttgaaatatatgttaggccatatgtgttcaagctgaggaaaggtaggttcagagagaaataatcttggccaatctcactctgctagtaagtagggctaagatttgatcgtctatacgtggatcgtggaactcatgttctttccctccactatgtatacttcctctgtactccctgaagacttaatctggatagagatacattgcctagagtttctctatagtgggagaaatgagccttttactttcgtggtaccacgtcagttgccaattgattctggcacataaaaatgtattatatctttacctgtttaattattttctgtaccacatcaaaggaacaagataaatttggttataatagtttattttactttaatttactattattagtcattgcagtacacaaatgcagatgtctgaagggatgcacaaagatgacaaatgaggcatgtaacatataaagaaatactacatttctaagtggtttacattatgtgtatgaacatgaattacctgcatggattatttttaagttcagaaactgtttttagttggttttctttcttttctatagctgttatttatgtctccagcttcatcttcaaagtggagatcataatatttatctcataagactcttaaaaaatgagataaaagcatttgatgaaagcatatgaaagcatttgactgagcaattagtataaagaagctacttagtacttatttgctatggtcacctgaaaagaaaagctattttgcatgcagtggtagggttgagaaacagccaatatattaaatattttaaaatatttttgtttaagttcaaccacctactttttagaaaatcacttagcatatgaaatttattttaagaggatacttactccacagttgctttagaagaaagaaaaagaaaatcagtttgtaaaatgagataattgtaagggtatctcatctttgtagccatatgagagagtccaaagagctaagcaaatatttgcgaaatgatatttttactatactggaagtaataaacaattaaaatgttgttattaaggcagtgctgatattataattttactatctctagaggaataccagagatcttattaaacacatgcttttttaaagttgaaatcttagataactattatcattactatatgtgtaagaaaacaacggcatggagaaagatgtgctctatagaaaactggtaggttattaaaatataaagaaatagggagaaaactgaaaattgcatgatattgtcaagtctcccttgggactcacccacacaacagttctttcattgcaagtttcttttttccttaatgagtcattttgagttctttttaatgtgggcacaaggaaacaaataaggattcttccatgcagctaaggcaccccaaatcttattaattcaaatgttgagagcattgaagccataaagacaataagaatactgaaacaccatgtatctgctttcatttaaatagccaaacaattctgtattttccaagtgggcttccttaatatacatattttaaaccttgtaaggtaattctccagagaaatatggaggtctaaaagacaaagtaattccatttatcaccttaaatctcatttaattagggaataattctgatatatcaagaaagaaactaattactgtcttctagatgcttgtgcttttgtaagaaacaaaagagctcaagcaagtagaagcctcaggaagagagcagtattacagagggaccacagcaacaatgtttttttttgttttttttgttttttttttttgagatggagtctcactctgtcgccaggctagagtgcagtggtgtgatcttggctcactgcaacctctgcctccagggttcaagcgattctcctgcctcagcctcctgagtactaccacactcagctaatttttgtatttttagtagagatggggtttcaccatattgtccaggatggtctctatctcttgaccgcgtgatccgccctcctcagcctcccaaagtgctgggattacaggcatgagccgtcacgcctggccaacaatccttattaatattaaaatttaaaaattggcttgaactggagaacacttcaaagctcatttaccacagaactttgtcatttttctccttatttgactcatctcagttggaaagcacagatgttttatgcgtctgccttgctcccactctccctaaaattttacttaccagctaaaccgccaatcctaatacatccaacaatattttaccatgaaaatacattcaatttttgtatttagatgcatacaagtctcctgaaattgtgaaatattccaactgtacttggaaagctctctgaagatccccccctcaaaaaaaaaaaaagaagattatctctagtggttatattttttgaaaggtttattgttctattgaatatatatctagttctttttcataaaaatgaatatcctggctttaagtaactgtttgctaagcacagtgtgcacagctatgcacacactgatatcaccattgccaattttattaaaagaaccacaatacagagcaaagagaaaaagagaagtgtccctattaatggtatttcaaatgcgtatttaaacagcttatctactccaaactaatttctgatagattaaatagctgtattccaaatcttacaagatgcacatctctcctctatttctttctcggcttgcttcagctgaatagctcaaattgtttggcactggtaaagcatgaaaatgtgagataaaaaaggaaacgaagctacagcctgagtggcctacaggccttagaaatggcaacactttaaaattcattatattttacattgcttcaacagttacacattttttttttttttttttttttggctcttgatgatgtcagaagatttatctgggatgtctgtctccacgggtaaatagtgaccggggtgaaaactgagggaactagggagcacctagaccccaagccttagtagtcagctctggaatgctccctgcagtgtggggtgtgagtgtggtgtctctgtgtctctgtgtacacactgtgtgtctgatgtgcagaggggaaggcagggaagaaatactatggcagacagtcacttgtggtagctctctaaagggatctggcacttcctgccatttcatggaaaagaggaatgagaaggaaataagcatttgttacatgcgggatctcactggatgctttcagtgctagaagggagctatttctcctcctaacgtctgtaactcaccagatttcactaattcagaggttgctttgaaactcagagtcaaattcatagccagggactaagtcttcatgatgtgcctttttgttttagcctcctttccggcatgttttttgtgttgctctccttcctgattactttttattagtgctatcttagtttatgtatttttataaactgccttaaatgctttctggaaccactgtgcatttaatcaaatagactaataactaactaggaaaatgatagggctgatagcatcgtctgacccatgaggaagctgaatttaagtagcttgtccaaggtcactcagcaagtcccttgtgctgtgagtctggttcttggctttcagtcagtattttcaagttttacctacttatttcctcttaactgaacacgaaaaaaacctcaaatgcttatttctttagctatttctatttctctgcagttaatgtcctatcaacttgaaattcctcccctgcctttcactcccagtagaagtttcgctcacctttcccaggatgcttgaaataccttctcatgaagcatttcttatcctgaaaaagcatcattgttacatctcttcttagacgctcctttgccttctgttttcaatctagaaatttgtttctcccccatctccatactgactaggattttgtttgcttgtttcagtttagatcacaggtgttaaaaagatgatcttacatatttaaatgatggacatatgattcctattatcttctacttctatgcattcctgatagacaactcttaggctggaaactaaaacaagaaggcctattaactatttttgcaaaataaaattgtattcttaaagttaagttcttgatgcagggagaaaacattttatgattttcattttacttcccacaataatacaagcatgtcaagtattgacctacaataaatgcttaataaaaacctagtatttttcagtcactttaacagggcattgtatatttaatgcattaacgctccataggccatgtctcctatgtactttgtatgctcagaaagggaagtaatgtacactggtggttaagaacatattaacctgagtacatctttaaacctcagctccactccttgcatgttgtatgacattggcgagtcatttaacagctatgggtctacatttcttcacctgtaaaatggggataataataatgtctatttaataaatgtattgtgatagttaactgaaataaaacatgtataaagcatgcaatagggcacatgggaagtattttataagtgttgtatgttattattaacctgtaaagaattcatacaagaaggcacagaaaaacatcaattgcaactaagatgaaaagtttgttgctgttagagcaggagtagttaagatggtatgtatttcaaatatccaaaagcttcttctatttctggagagcaaccatgggaagtctattgtggcattagatagtgccacagagaaaagacaacaggatggtgaggacaggagttgggagggtggagccaaggaatcaaataatgtggtttcctagatgacattcttttcagaagcccagaggtgccacatctattacaaagtctctaaccaaaccatatccatgaacctatacaagataaattttaacagagtgcagattgtctttcactctacatcaaactatagagtccagaaaaaatattttatatcatgatagtgataataattgaaggaatcagaaggagttgatcattctctacaagcttgttgtcatgaggagggaggtgaaaagcattaaaaaaaagcttaaacccttttcccaatatttcaaagtagctttgatggtatttagatagcaaactcattttaaagagaataggattttcacaaaacggaaaaatcaagcagctggcatagtaagttatctgaatttgatctgaattgacgtcagggagctgggaatgcccctggcaatcctgcattctctctctttgtgcagtattttgacagtagtgagaatgtctgagtgttaatcattttctgacagtgtaggctctaatcttatgcaaaatgaaagcatttagagattttaccttcttggttccaatcagggcatttcttctagaaaaactattctgcagtaagattgtgtataacttattttacatttgtatatgtttatatatatttatatttatataataaacctaaaaatatgtaactgctaagtttggtagtagcctttcttcaaagcatcattcttgagaagagagtttattttgtaaaaccttactggtagagacataaatctaaaaaacaaaattcaatccagacttttgtatccaaatatgaatgttaatttcctgggtatatctttttttaaaaacttgcagtgtgggtatataagcagggccagatgtctctgtgttaatcatttctactctttaataaataacggtggcgtacagtgaaaataaagcccagatggctgacacattgcacaaatcactggatgcactgtatattcatttcatagtttcctgaatactaatagatgatagagtcatcatctttttatctgttcctcagtcaaataacaagtaactacttactgtgtcttctaaaagccactgtgctagtggctaggtaggttataaaaacccaccagatattgcagatagtaccacaatataatttgctttaatctctatgaccttcagaatctattacatcctagtcttccctaggagactggggtttcttggaattattttaaaaaagtgatccaaaactggatctgattttgccatggggattgcttaactaattggtttattagcttgagtctcatgcatcatggtggatattactggttgtcaagttgtggttggtgaatcgtagacttttagaactctcagagaaattcagagttgacccacattacattttacagatgagaaaatgtgaaacaaatgactaaatggtttcactagagccagacagttactgtcagaattgaagcttaaactacaggctgctaacttgtagtctgcagcttttgctagtatgtatgttactttgtctcagaaatgtagtgaaattaaatgtagtgagattaaaatcggtatcacaggaatgaaggtgcagtaactttgggtttgctgctgccattgactcagggtgggatgaaagaaggggaacggacatcattgcacctgcttcatttgtttgttctagaaggaaaataaggaaatgaggtctggctccacacagtgtttcagtgggggctttaactggtctagattatctagaatttttcaatatacagaacttaataggcacagacactcaaatgataggggagtcaagtattcacaaagatatgacatttacagagccagtctgcaaagataaagatatgctaagtggttgtctgtagacaattatagtccattacaagttgagcataaaaacataagcattattcatcagatactgaatcaccagttagtgctggtatttagatgaaaacatttggcttggaggggaagcccctcaaaaaccatagttttgacttgtttctaagaacctgcctgtcatggaaaagcctagaccctagtggaattccccagggatgttttacatagttgggattctcagtagttgatgatattgggaagcagaacataaccagaggagctgggagtcagccctgcccaggtggggcccaagcaaaaaccatactctgcctttccccaagtcacaataaattgtgttctgctaagttgtagttacactgtctcttcaaacagagaccataataatctttgctgcatttattcagttttatgtttatgctagtgatgtttgtcacttagttaaaattagctttaatatggaagaagagggtatacctctttctggaaatgtaacactcagccttaaaggtaaagggagcagcaaaggtgtccctaaaaagcaacttgcatcctgagcactgtgtggatagaggccactgttgccagacatccagccttagcaggttgcagccttagcaggttgtgctgtctttgtatgtggtcattttggtaccatccagaacccccacttactctcctgctcctccaccaccacctccagtccctggttgcaatgagccacacaaaacagaggaaagtaaacgggcattaccttagtatcagcaatgctgggatatagttctgctggtagctcctcctaaaaatacacccctaaaaaataaaattgtaagaaaaaaagagttaaaaataaaaagtttcagtctccttgccctgggcaggtccttggaactgtagaggattttaaaggctatgaaaattattttttatggaattccagagagggggatgggctcaagtttatatgtgagatacatatttacttatttaatagatttgaaaatttatttctatgtttattagtcagggttcttcaaaggacagaacctatatgatatatgcatacatagaaagagatttattttaaggaatttactcccacagctacagagactgagaagttccaagatctgcagccaataagctggagacccaggagagctgctggtataagttccagtctgaaagctggcaggcttgatacccaaaaggagcaaatgtttcagttcatgtccaaaggcaggaaaaaaccaacctcccagctcaggcaggcaggaggaatcctctcttacttgtggaaggttcagcctttatgttctatgcaggccttcagctgattggatgagggccatccaaatgtaggagagtaaccgctttcctcagtctaccagttcaaatgttactcttatccaaaaacaccctcacacacataccccagatgatgttaattaaatatctgggcacccagtgacccagtcaaattgacacataaaatcaatcatcccaccatgtatatttattcatatgtaaaatagtagatttatgtaggaaatagaaaaatgatggttattattagagaggagcataagaaggaaatttgtgatttgaagatttagagtccattattgctaatgaccattaagcaagaatcaaaaaattttgccctgttatgataatgatgtgtacaccattctaaaaataatccttatttactaaggcatcacaataacttctatgggtccatttcagacacaacaagggcgaatcacctttttccttttatttctttgacttctgttgaatattttttatgaaaaatcttgaatttctaagggcatattcttttatcactacagggatgattttgcctgaatatctgaaatagcattgcaaaatgattttctttagcactttacaactgtaaaagaaggtcattttaaaggcagtatttaaaagaacaatgccacaataagtggctcttctcattgcccttacattcttttaaaaagaagagaccagtagacaatggttaaaccagcatgtttcaacaaacacatcatcacttaattaattgaagcaactttccaaaagtattaaggaattaaaatatgtaatgctctagaataggagaagcctaataagccaaataagttcaactatgaaaaaatatctgtcattttgttaattcacaagctggagagggtatgaatgttaaggggatgttgtagctagcctagagacttactcttaggtctaaggcaggtacttaaaatgtgagagttgaaaagaaatttttttttattatttttcttttttcctgaagaagtgggttttgtaagcacaaaggatgtagagaaaaaccatgctttttgattcagactgcagtggggaaggtatgcaaattaacttataatttctatgccaaagatttttttttggctctttctctaaatattttactaatatcttacggcatacagattggtctcccaacttgcaggagacattttttggaggttgtatttttaatttttttttcaatactgaaaaattttataggggaaatgagaagagccagatgatgaatggcttcaacaaagggactgtggtcaataatgacagtgatgggaacaacgaaatgaccaaaggtcttgatttccaagaaaagtcaaatcatgaaggcttcatgttggaggagaccacagaagtgtggagactcaggcaggttccgggattttaaaactctaccgctggagcagcctttccttaccaccacccaaatgcacccatagagcagggaataggggtcagaaattatggagatttccacttgaagggttccatgggtctaattcaactcccattttagagatgaagcaggtgagtctcagagaagtgaatgatatattcaggacatatggctaaggggtgaccaactgcagactaggcttcttgactcgaacttttttttttttttggactacattgtattactccccagtctattaaaaagtttaactgccatattgaacaagcaagactcatacagcaaagtcagaaaacatttgcctttccctccactgtcattaaaatccaataaagagttaggtcttagcatgccaatgggactctaaaaagaaatcctctctaggattttttgtctccctttgacctcttttaaaggctgtatgtggggtataagctaacggtcagaatagctgcgcctttgcaagtcctaccagatgttgcagcaactccagagtgtaggaatatttgccatctattgttttgtccttggccttgttaggacttctactgcaaatagagacaaagagccttcaggaacattctgctgtgcaagtggtcaccaagttcatgtgcatgacactgccctggtcattgctgtcctggttactctgcaaacactaaagccgattggccttgacttaaaatccatttcaagggaggagaataacataaattgttttaatcagggcaagttttattgtaataaagtaaatgacacaaaggcaggaactacactgccctattggttattatcacctgtctggcacacagtaactgctcaataaatgaatgagtgaacagaaacctattaattggatcaagtaaaaagagacttattggaaagatacaaagtaatttaagaaaaatgtcatattggaaaataatgcctggcttcatggggtattcccatcctggcatattggacccattaacctctcagtgaatctcagtgacccaacatggccacatgccatgatgatgtgactacagtgcccatcgtgaatgaagggaagcagaagcactcttgagtggtctgggttggaccagaacctgggtgttgggtggtagtgggaaatagataagggaggtaatctgtgacattggcagatggcatttttattaaatctcagactattcagagagtacgtgggaacattatcttcattgtaatatgatcttcttgaaaggatagttattcaaataaaaatatatactttccatgtatatgaacaataatgttgcatttattctaatgttacatttattctaatgtaaactattctatcctttttgataactttgcaaactgaaaactattactgaacagtttgaattaaaaaaaaaagcttggagtactataatattcatgaacaaaaatcttggagaatttcttctttaatgaagttattgaaatgctcatgcctataaaatttttcaatattgaaaaaaaattaaaaatacaacctccaaaaaatgtctcctgtaagttgggagaccaagagaccaatctgtatgccgtaagatattagtaaaatgtttggagaaagagccaaaaaaaaatgcttggcatagaaattataagttaatgtgcatactctccccactgtagtctgaatttacaagatatatgccatgattattctctcagaagattttttatgagttcagtactgtcttgattaagcttatgactaaataaacttcttttcatgacattgtcgaagagtatcagttttcagacagtgagaaaaggacaagcagctggaatcagctgagaacccaacaatctattgtaaaaatacggtttattttaccactcggcatatgtattcatacacatatatgtatattcaactgagacaaaagtttcacaaaatcctgcttactcttactacatgtgatgatctctgatacatgtgatgatctctattctgtttgttttaaagtttgtcacaacacatgaaatttgtttcacaaccttcctgttggtcatgagctctgtttgaaatatgcagactcaaggcaaaaatgtaaatgggaaatttggaattattatccaggttggaaggattaaaaaatagaaaatacgtatgatttcacctttctttcttctgaggccagataaaggtaactagtctgaaatctagttatttatttatctggaattgtttagggttaaccatagctagtaagggtagactgtggatgtagtacagtagctacttaaaagctgttatgtcatgagcctcccaaccatgacggtgcttaggaactctccagggagcattgtaaagtatgcaaaagtcctggaaactctaggccaagtgatttagaatctctgagcatggggcctgagcatcagtatttttaagaaactccccaggtaattgtaatatgaagctaggacccaaaccatcaatagcaactctgagtagatgcctttgccttgtgcactgaatacttttgtcatgttaacaatgcttttttgtcatattttatgacgtgtttcttgtgtatcacccaaaagcaacagatatttttgaataacagaggttactatgagcatacagttatgcacatcattgaacctcaaattttaagatacttattactaaaatgttatactgtgatttattgaaaattttatgaagaattcattgacaggagcaggttatatgttaagtgctacttttctagttgaatgtggctcaggagaaatctagttaactaagtcaaatagatagtttttaatacttatatttatttaaatagtagacttccataatcctcagttattttatgtcttccaaaaccaaaaataatttctttaattttgtcatagattttaattgaaattggtgaacatatgcacacatacacaaaaactgtagatttagtgtctgtggtatgtaattgatgaactgttttctaaaaggattttgaacgtttagaaaactaattaagatatttaaattattgacaaatagaggatctttctgtacccaatttaaaaagaagatacaatgatttgtggttagtgtatccatttttcaaacataaacagaaacttcagaagttcttaaaaacaggttgtccttttagataatttctacatttcctctgaaatcttatttctgaattaagtctagatgtttacaatctatctgaaaaaagtaatgttgttataaacctcaaatccgtgctcatacaaattcttaccatttccaattagataatactctggcaagaattactaatgcctgaaaaaatagatgtaaatattcccatatgatggtaattattaaatgttatcaactaagtatagtgttttgttttaattttaacttttattttagatacagggggcacatgtgcaggtttgttacatgggtatattgtatgatgctgagatttggagtatggactctgtcacccagatagtgagcatagcatccaataagtagttttcccacccaaactctcctccctcccttccccttctagtagtctgcagtatctgttgttcccatgtttccgtccatgtgtactcggtgtttagctcccacttacaagtgagagcgtgtggtatttggttttatgttccagcattaatttgcttaggattatggcctccagttgcatccatgttgctgcagaggacatgattttgctcttttttatggctgcatagtatttcatggtgtatttgtaccacattttctttatccaaaccaccactgatagggtgggtttcatgtctttgctattgtgaacagtgtggagatgaacatatgagtgcatgtgtctttttggtggaatgatttgtattctttgggcatatacccagtaatgggattgctaggttgaatggtacctctgttttaagttctttgagaaatctccaaactacttttcacagtggctgaagtaatttacatgtccaccaacagcgtataagcagtcaatttcctccacaatcctgccagtatctgttgttttttaactttttaataatagcctaaatgtagtattttaaaatatctaagagtttcttacctgaacctagccaatgtattttttcatcttattaaattacatacacttttattttagccctcattgatttattaggtatataagtaagcatattttgtagagattctttaatttttttttttttttttttttattatactctaagttttagggtacatgtgcacattgtgcaggttagttaatattttatagcactaatatgtccttttgttttttaagaataaaatttataaattgttttataagagtaaaatcaatgtaatagctgctgctgctcagtacaattaaacaagttacagaaatcctttactcagtatcactaccaaattttttctaatattctcattttaattttttgtaggtggtttttacagttgcctttatatattctgtcaattgtgaatagaaattcaaattcttgaatttgataattgtgtcatttttgtgttccctagcttttatttgtagactgttggtcctattgttctttttcatgtgttactattatctctggatattttcttataaattattgaaacttatgagattcaattaccttccaaagtgatttattgttacgtgctgtaatgctattaataagtgtagtttgcaagcaatgtttcaaaattttgtctacttaaaatttagaacaggatatttattttgtaatttttggatagatagaaaatctcctttctgccatcatgaaactgataaatgagttatagggatgggaggagatggacatttgaccacatgcaatgcagttttccaaagtatataaccataatctatattaaaggtaaatgcagtgtcagatgggcattactttatgcaagattgtgttgctcatgaacttaccagccaaaggagactatctctcactaaggcttatgtaaaactgccaggagagaataattacagtgggagtaaatttgaacacatgcagtagaatgtctaaaagttaagcttctcagagaaaatgtacatatgcttggattttacaaatgatgtatttccaggtattcactaggcctgctaaaataagttagcattttttaaagataaatatgttactgaaatatatcctacataaagtaccaaattataggtttacagtttgatgaattcctgcaaagtgaacacatctatgtaatctccatcctgatcaggaaatagaacattgtcaattctcccagaagtccctggtaccataccccagtcccctcccaccacatcacataagattaggttttgtctgttttgtttttttaccattttgtgttcttggtgagagtgctgcttttccataagcaatttcactgtatccagaaacagaactcagttaaattttaaggccactattttcttcataaaatagagggaagggagaataggttggtgggaggaaactcgtgcttctgattctttccctagcctatgatcaacataatcatgccttaagaaccttgctttctgtctttgagtgacatgcttggaaaagtttttgaaaacatcagtttgtgttctttacatattcattgtataactctattttatatggtattaataataaaatggaaacaaacagaattgtggaggggaaaaaaagagaaattttaaagacaagcctgccctctaatttcctttttgccatgagtagtcagtgggaagactctgggagcttggggacattgaggcatacagcagtcaacaagcctgagccctacaacgactgagtctggaaagtttagattctgaaagcctaaaaaagcactgtgtaagaggctaagccaacctttttgttgttgttaatctttttactgggagacaagaatggaccttagggatagggtaaaaaactgagagcccccagcccctttaagatattttctctaaacctcttaaagttaactctgattaatttcttggttagaattcaagttatggttcctgctctgcaaaactaataggtagtttaaggtgggaaaagtaaaaattcttgccatctcctacattgacttgagagtgaaagtaagactacagatttgttatccccaagacagttgtagaaaactgagattatgctttataataccctatttcaagtggggttaatatataaccatggttcttagccttatttggggttagagacccctttgagaatctgaataaagctatatgtcttctctgaaaggtgtacctaggtacacataatttagccactggccttgtccgtttgcaggccccgtaagctaatgcacagttccctctgaggatccctcagctttattctaaagtctaaaattctctaacggttgccagtggaaataatccaggagtgatagaagtatggtccttattacagttatctaggaaggagaccacactgtcttcatcctttacccttccttggtttcaccttcttccttcatgacttgaagattcctttattttctcttacttccaactcaaaattatattggttcatgctggtttcctttgtttaacagaaatattccttttgcaaaatggtaaacacctttttagggggaaaaaaaacccaaccaacactgttcctacagttgtagatagtaattaagtcaaacccttagttggttttcatttttgaatttaatactgcaaaaaattaacttttttgcataaaactttttatgacttcagttattaatattttattattttgattaattttatgtaagtcaagatagtctaggttattctgcagtaatccaaaatctaagtggcttaatataacaaattttatttcttgttctcttcatacatacccaagagggattggcaagaggctctacttattgtagtaaacctgggacccaagatgattgatgctttatctcaactcaggcttcttcaccagggaaaaatgatgtaatgaatccgtcacaggttgcctgaactttcacctagaagtgacacataccacttttgcttaaaataattggtcaaagtatatcccatgttcatgtaggataccaaaggggaggctaagggcaatcttaccatgtgaccagaaaaaggaaagctagaagtatttggtagacacattcactcttttctgtactcctttccaaattctcctaactttttggagatttgattgatgttaagcagaaaaagagggtttgagtcttatttttggtgaaagaaaatattcttggttaactttgtcatataatatatctgaacttaaaataagtacacagtggcatataatgaacttaaaagaaataaaatactagcaggaatgtaaaaaacctgaacataacactgaattgctcttgttagtgttatgccacttagttccatctacagtctagcccttgtaataacacacacaccgtgattttagttaaataggaacatgcccctttctgtttcatttaaaattctagtcaacacaaattcttctagaaaaatgaattaagaatgagtactattcccagagtacattctggtttgtctataaattctaagctaagctttatatgggaactgtcaaaggcacagttgcaatgttgctgccttttttattcaggagaactgacttctgttgtcccacttggactgatatgttgagtgatgaaaagctgggcaaatctcctcagtcactttcttctgatagtttactttatggcttccttagtggtctgcatcattctttcagcctgaccatttgcttgagggtgatgaagagtaatgatgacaggttagatgagctctagcttcacaaatttcttaaatgcatctgaaacaaatgcagattcattgtcaggaataataacatctgggaatctggacattgaaaatcattggtacagggatgttcttgttgaagtagagacactataaggcattttgagatggtagccacaacaaacaagaaattctcctccttgaaaaataaaagaattattgatcaaatcttcctgatcattttttataggaaggaaaagtacctttggtggattatatggagtggcttggtgttgtctacagtcttctaaatgacataattaagtacaggctttagatataattattagtgtatatatcattttaaaattcccaggtgaattgtaaacattattgtaataatgtgataagttatgtgatttctctattctggccactcgaaattaagaattaaagctttgattagaaattagagtctaaactatatatttgagaggcattagtatagttgaaactatgagagtattttggtttactgagctagtttatgtgagaaagcaaaagacctgaaacagtcttttttcagtatgtattgtattctagacttttttctaggtcattctttctttccatattttctcttttttttttttttttttttcatgagaaagcagaatgattcaaactgggtataactatattaaaggccatgaacctagctttgtctgacaataaaagtcatgctcttattgctagattaaacttcctcctgtttatagtgtctgatgggattaaagagagaggatcttatgtaagtaagaaagtaatctttttcctacaatctgcttttagcccttactttcctcctatgttgagagcatttctagtccaaagttcttttttttaagtcattaagatgtattattcaatctcaagtaacttttaatccctttgtaaaaatattagctctttaattaggcttggtgtgcctagccagctgtctccagcataattttgggtaggcattagtatgttaatatggaactggcttataatcttaatttcaaagcatattggaaggcaagttttatgaatagtataaagagacttatatgacctgtcaaatcaattcataaaattcctattttgaaggggaaattaaaagtcaaggtaatggaaatgttatattcgtatattcgcaggagatgaatgacatggataggatgtctttgaaagttaatgagaaagctacttgccaggcaagttgttcaagagcaatgttagcaaatgaaatgggttgctgcctttggggaaatgatttatgatgatgaaaaccatctgggtttaggaggttggttgatgtgacatacctctcttccagcctttccactctctcttctttcctgtgcccagcataaaatcagtctttgcgtataaagagcgctatgcaagttggcttccagtcatacgaatatgtggtatgatttcaaataagattgtcattggatgctttggtcagcaagcatatttactttagatttgtatttactctttgtagttgaactggctaaactctaacaaagtatgcttcatttgactttaataaaatattatatttccaagaccgtatgtagtaatagcagaaggtgtgatttctctttttgcataaattggctcttcccttctctttctctgtgtttttcacatctccctactgtcatatatattctgacctgcctctggtagggctatttatgtcatatccataattgttatatattaaccatttgaatgtggaataaggcaagtacagtttaatttttttatataaaaaatatggaatatactgtaaatgagttctcttaatcacggagtagctacctctggaagctgtaactgttggtcttgggctgtaatatattatactacaaccttaaaaatgaagaaaacaaaaagacaacactctatgtgctgctagacaaaggccacagttaaagccaaactgcttgacactttatattcttcaggcctttttaacgaccttccctttgggtgatgcattttgtagctgttgtcacttgtacagcagagagggaaaaggaaatgaataatctgatttgaaggggtgtagagggatgtgagtcttaggaagatccttaggatttacagaagctataaagctatttgtgctgctttgtggtgctttgcaccctgtgtcagttaatagtttatctttaccccattttatgctctaagatatagatgatgttttaaaaatcattctcatagtcttctttcctcaagctccaccccaagttttctagctcctgaccagcactgttagcttttttgatttaatcttcacagtcttctcatttatgaaatacaaaatgaatgctatgtcaagacagacttggaaaaatcttttaaaatggcaatacaggctcacctgcaattaaagtcattccattccatttagtgtctttttctttttctttttgagacagggcctcactctattgcccaggctggagtgcagtggcaggatcatggctcactgtagccttgacttcctgggctcaagcagtcctcctgcctctgcctccctagtagctatgaccacagatgcatgccaccattcctggctatgtattttttaatttttagtagagacagggtctcaatatgtggcctaacctggtctcaaactgctgggcttaagcaatcctcccacctcagcctcccagagtgctgggattttgggatcccaggtatgagccattgcactcggctccatttagcttctgatgagtgtaaatattaactttgaggtcagttcacagtttgctgatattaggactgattttttttaagttatatttcatttaatagtggagcaccttaggaaaaaacaaatctctttatatatagaattaaatttgtgaacttttctgaagtacatttttatccttttaaatatgccacaacatctatcctgtaagtaaaataaatatttctaaatgtctaaagcagagaaatattataaattaattaaaatatttcctgaaaaacaaagtaaatcaatttctcaatttacattattcagataaaaatagctcaagaactagctaaacagtattagtgaaattgaaggtcaagagatgctagaaattagtcaactcaggtttatggaagatcttactatatactctgtaatattcaaaactatttctcggcttaattcactgatgaaattatggtattttggtagttggaattaccaactgtctgcaacagcatgaactgacaagaaaatagtgccctctatgagtaggagtacagaatgttatcttattaacaagaaccaggggacagtaggaatggacaacagcattggttagtggcacagaccaattcaaataatatattttgtgtgattttttttttccttaccagcagtttgttggtgaggcagaattaaatagggaagagaaatgcacattccctatctctgtccctgcagtttcattaaattctgaccaaattatgtgactcagcattctcagagaatagtctctgacaggtagcacttacaggagacagacccacaccttctagcatgtgattcttaaaactctgtgtgcagactggtgcccagctaaccacataaaatttaccaggggtgcttattaaaaatggaaattccaaaatcttacctccagagatgctatcttggtgggccctgagaacatcatgtttttgacgaagtcgcccaatgcctttctggcgtggtcaaaagcaagaagcacaatgcctttttgtgcttcttggttttgaccaagtcacccagatgattgtggtgcaatgcctttttgtgcttctgcctttagcgttggtttgcccagccagcaccagatcaggcagctctattagctgctgctatcagcacgtggatgttctctcctcttcgtaaatgagatctcctctactctcccaaaagtcccatattcttttgggactctttcttttgttagctcttgcttgtcaagaatggaatggggaaatcatttcctatggaggaagtttttctttggcttttggtaactgacagagtgaacagatttcttcgctgggtatgcactgtgccttctcccacctattccagagctgtcactcaggagcactgttcaaggccatcccctgccttccttgtgtagagggctttctgtgaccagcagacagtcaaagacatcgtatctatacacagatggcacattgatgaaaactactgatgtttgccacttattatttattcttttttcctaaatatttacaaaaattacttttctcttttgtatgccacatctgactatgtgtgttagtttttgttttttgtttgtttgtttgtttgttttttgagatggagtctcactctgtcaaccaggctggagtgcggtggcgtgatctcagctcactgcaaggtccgtctccttggttcatgccattctcctgcctcaacctcccaagtagctgggactacaggcacccgctaccacgccctgctaatttttttgtatttttagtagagacagagtttcactgtgttagccaggacggtctcgatctcctgacctcgtgatccacccacctctgcctcccaaagtgctgggattacaagcatgagccaccgcacctggccgtgtgttagtttttatatctatgttagtaccgcaaaaatgtctaagaaagcagacccttctaccaacactacaatgtctcatattgcaggaggcctcatagttaggaagacaactgttagcaaagcccttgtttctctcatgagccaccagtgtctggcatatctcaatgcactcttcatgatgctctaagctctaagttaggcctatggttgcattgaagctctaagttaggcctatgattaaagtcttctggctcataatgataaaagccattattgtaggcagttagaacctgttgaaggacagagacgtgatggattacagtctgagataatgtaagttgtttaaaaaagtgaaaataaaagaaaatcaaaactttgctttacctattcatttttaaaataaccaaggcataccccttttgctgtcttaagtttcagacaagggtgcaacttctacagtcattccttggtggctttacatgctttatttgccatgggccattaggtgctatgggtgttttcatccccactttggtgctttgtcaagacatcaagcatctccatgaatatactttaatctttcccttttttgtgttttgttttttaggtaagtacttttggtattcttcttccttaatgctgaaagaaaatgcagctgcctgatgtagaacaaatggcttttgaaagcaaaatccaaaagataaaaaataatgtgaacagtaaagaatgacaccataccagatactggtaagaattttaagtggcattcaaacacccctctctttttggagagaggactaacagtacaggaagatgcggggagggtggggagggattgttgccgtgcaagtaaaaagaaaattacagacagtgttcatgaaatattcatttacacctgcttattggttagatgaacagcctttggttctgagctggctcaccattcccaggctggaaattattcacttaaatgcagcttttaaacattttcttaaaatcctcaatggaaacagatgtgcacatgctgagggaacttttttttgatctttttctagaagagggttaaattagaaaaaaaaaccagtatttttaatatttaatttcatgtgtatagctatgaagctatatacttaaatgctttgtaacatatgatcatgaatatatgtataaacttcacccagaaaaatccataaagcttttgacaataaatgtgtataatctggataaatgaaataccagtgaactcaaacataatttatttcatgttttatgtcttctctttctcattttccatgtacaattcctgtgtacatatgaaataacatacaaaatacaattgtacgtatgcttcaatggcattttgcccaaattcatagtccttttttatatggccgtggatttcgagatttaaacatatatggtaaatagtatgtttctgttaacttcagcatagcccttttagtaacaagacattgtttactataaattgagattatctatccaatgtgagtaaatatattattaaaaatacattaacatttaagatgaacaaatagcaaaggttaaaaggtttcagagaccattacctgttactaaatcatttctctctcccatttactagtcttatctcattgagtttcctgctgtcctagaatgtcatccctctgtctctgctttatttagtttttgtctatattcaactcagaccctatatcatgtacaaagctttcctcaagtctttgaacacagactggtttattcctgccctaaaatcattttttaatagaatccatgtgttaattttctgaggctgccataacaaagtgccacagactgcaagcgtaaatagtaggaattgatttactgatagttctggaggctggaagtctgaagtcaagagagcagggttggtttcttctgaggcctctctcctcagcttgtagatggctgacttctctctattccttcacggggtctttcctctgtatgtgtctgtgtccttagctcctcttataacaacgtcacatttgattagggcccacacttatgacctcaacttaatcacctcctttaaaccctgtctccaaatatagtcatattctgaggtacgaggacttcaacgtacaaattttggaggtatatgtacgaggacttcaatgtatgaattttgggtataggattcaccccgtaacagcccatgttagtttctcacttcattattctctgattcttccatgtatattggttctatcttccctaacaagttcatcaaggataaggattgatcatatttcaagttttgtttacttcattcacagttcctagagggctggcatataatattaaatgctacatatttgttgtttgaaattactggaaaaagtagcataacaggaccaaatgagagcctctttttccaattattgctgactttagctcccttatctggacagaaaaaaacagtagcagaggtttgagtcaggcagtggtcaaatgaactgtctctgctttctttctgggaggcccaacagcattctcgtcagcaggagcattctggcgaaaggaaatgctgatctctgcaaatgggcaaaagtgtaaagagcattgaacccagcctcataccacagaaaacaatttgggcttgtggaaaataattacccagtgaagagtcttctgaactagaggcaggtttttggagggggaaatcataaacacatttgtggttgcaaggtagcagattgggtgagctgaaactaaaacaaattttggtttaagaaattgtattttaagttctgaagtcatacttaattcttaataattctaattgtacacacgctaatttaaatggaagatgtttacttcattaaaatttcaacactaaaatgctggttcagtttgttgtattactttcttcaggttttgttatattctatttttcataatttctagagccagcattcaaaagtaatttctgtgcttcaaaataggatcatcctaaattcaaattatatgtaaatgtcattgaatgcagatataaacatggtgccacaattttatagaaaattctaaaaaaacaaaacaaaacagaataaccatgttgctctcgtaccaaacgtgtctttgggtgggttactaagtccacctgagtctgagattctccatctgtaaaaaaggaatcagaatacctactttgggcagttgctgatattaaatttaaataagcaaagcagttagcccagtcatgtcaaaatagttgagcccaatgaatggtctttttctttatctctcttcaggttgaattttgcacagtagataatccatctatcacagaggtgtgcagatgtgactgattcattgattgaaacattcattgccccatttaaacaatgtttaggtattattatccactgtatcctggtttcatgctggatgttgggtaaataatgatgagaagaaacagacaactccaactttaatggagaaattgacattaaaagtctaaaaatatgtataaaattttaaaaaatcagtgttgtgtagtaaatatacacagtaccaggagattttataacagggagggtatgtgtaaaatgtcaggaaatatttctcctaggatgtaacaatgaggagagtttcagagtatgcatgtgtgcacatatgtgtatgtgcacatgtatggatatgtgttccaaaagtaatagtggttaaggtggtgatggtagtggtggtgtaggtggtgatggtggtaggagaagcaagagaatgaaataaataaaaagatgagtgtctgggaacagcatgtgcaaagtcctgatgtaggaaacagtactgaatggacagtacggtttaccaagggagggctggtgaggctgagatgaagagagctaacaggaagccagtaacttgagatgaggctagagaggagagcagaggccaactggagcaaaaccttatagacatattaggtcttctaccctaagaacaatgggaagccacctaattttaagagaaagcttaatggatgtgtgtgattcagtgcagggactgctaccgctcttaatcctcgaaatatcctgctaaccaggttggctttagtgggtggaaaagtgaggcccatacatattcaaatttgtattttgaaaagattttttttttgtcctccaatgcttttgccagaatatagaaattcaaagtatgtgtatttatagcaaatacgtagatgtttttcaccttataggtgtgtttttatcacattatttttgcacatatgattcctgcatgacccgagtgaaggggtgggttgcccctccacacctgtgggtgtttctcattaggtggaacgagagacttggaaaagaaaaagacacagagacaaagtatagagaaagaaataaggggacccagggaaccagcgttcagcgtatggaggatcccgccagcctctgagttcccttagtatttattgatcattcgtgggtgtttctctgagagggggatgtgtcagggtcacaaggcaatagtggggagagggtcagcagacaaacacgtgaacaaaggtctttgcatcatagacaaggtaaagaatcaagtgctgtgcttttagatatgcatacacataaacatctcaatgctttacaaagcagtattgctgcccgcatgtcccacctccagccttaaggcggtttttccctatctcagtagatggaacgtacaatcgggttttatagtgagacattccattgcccagggaggggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttgaacaatacctggctttcctaggcagaggtccctgcagccttccgcagtttttgtgtccctgggtacttgagattagggagtggtgatgactcttaaggagcatgctgccttcaagcatctgtttaacaaagcacatcttgcacaacccttaatccattcaaccctgagtttgacacagcacatatttcagagagcacggggttgggggtaaggtcacagattaacagaatctcaaggcagaagaatttttcttagtgcagaacaaaatggagtctcctatgtctacttctttctacacagacacagtgacaatctgatctctcttgcttttccccacacccgagatcttttaatattctaacatactcttatgttctaaatcagtgacacttagaaagaaatgttgacttgaacatccaagtacaggtgctaatttgacctagcagaaacattttttaaggaaatctctctgcactgagcacttgcattatctagcaatggaaaattcaaacaatagaatgattatcataaattcctttgaatacctttgttagcagagatgaaaccttggccacctggctttaagggaaagcttaatgagcatgtgattcagtgcggggactgttacctctcttaatcctagaaacatcatgggaaccaggtttgcatcagtaatgaatttttataatgtgaatctttgattttctttcgctggtaagaaaccttatttggagatgctatgtatgtgagtttaatctcattttccattccttcttgaagctttctaggttaaccacctgaaacagtggttactataatcagtaaagatttataaccaaagtataaggaattggggaatttccatatggtgtgtcctcacaaacaaacgtcatgtttcaatatgatatgaatgcatctccatccaaattattattttaactgtatatttttccctcagtcagcaatttatgtaacacatatatttcatttcatccaactcctaataagagacccctaaattaaccttgaactatgatttacaccttctcaatatacagtcaataattgaatttaatgactaaccaaggacattttagtcattgcaactgcttacaagattatatgtaaaggattcaggaataaatagaggggtctctcagtatgaagtttaaataaatacttaatgataaaagaaaaatttgtctgcagtttttttttttacaattaactttttacaagttattatccccttaggctcattccattctgctccctttgttttgaaacactgttatgacatactactgtcagtaatggaatgtcagaaaatagtacatatgaaagacacagttcattctactgttaaatattacatcattgaagggtttaaatcctaagacgtatctttgatttaccagcccagcccaacttcctatttgctctctgctccatttagtagatttcatgctggttgctggactaaacaagtcaaacacctgcaagggccctccatctgtggccagaaaagtgttgctggtggtatatttttgatgtttaggaagaaatattgatctgcttaactaagatggtcataagataatatggggttgtactcatctgattctcacaaaaccccagggtgctcagaactatactgatgtgttggagatgctacttaggaaattagaggaccagcatgcatgtcctttggaatgatgtatgccaccctatcatctgcttggccaacaacttgagccaagacacacctggggtatcttggtactacctagagaccctagctaattttgccagggtggattggtagaatccaaggaaatagttttgcaagtgacacaattggtggatgatataataagataatgaagactaaaataatttgaagaagggaaatggagataatttaggctaagttgttctatttgctattcttagaagtgttttcttcacatttagaagaagaacaattgattataaaatcactgctttgatgcattaatttgatcattctaaacaggtgatgaatattgtcttatgttatttgcctccattacttaatctgactatcatagaatagctaagaatacttcttaagaatgagagtttgcaactaccagtcacataggccagtatctgttaacaaaatgctagtaattttgttcattaaattttaaacattaaatctattattgcattaagacctattaaaatggacaataagtaagggccagatatatcatgagtagaaggagtccctttctactgagagcctatggaaaggacaactagattccagaaaaatctgttcaacttccaggatggcatactaggagaaataaattgggggtctaaagagtaataagcaggaaaaaaatctggttttctttgaggcaatgattagttgaagcctacacaaataaaccaattacaacattttgactgaactgagaataattacactggtagtcaactcctggggaaaaattatgaagttcaggctgtaagctgtctaggcttttattaacttgcattgttcttaactgattacaggcaaaaaggtcaaaacattttggcctacctaggtagccagatggtctagagataatttcttaattaccaaatgactgtgttttatagtgtcccttaggaaaccaagttttaaaactgtgtctaaagagaacctgatttaattttttgatgtttcttttatttttgcttgattatatattataatcattttgtaaaaaaaaatccaaacactacagaaatataacttagatgtttataatcttcgcttctctcttagataactatttctaagagtttttgtatacatatttagatttttgatacatgtaaatatatataatcttttttactaaaatggtaatttacaacatgcttttaaacaaacttttttttttacctaaaatttcttagctatttatgtcagtacatgttgctctatgaagttgtaaacagaacaaagcagcgtgctccccaagaggactcttagatatttgaaagtagcccataatggtaaagtaaattcattcctgactttgcttgaggaaactaacatcctctccatcctgccttgaggacaagtgtgttccttcatggctgacacatatcttggcagagcacatgtgctgcaacagcacacagtatggggtaggaacaggatttgagtgatttactaatcaagtgttggctagaagagaggagacttgtaccaccccgaccctgcatcatgcctcttgctctcctctttagggtgaatgtaaaggggaatctgcccagttggggtacagataaaccttttggttaccagactgttggggtttagatgtcaactctttataggaattgtctaggaaagtcagctgtccaggcttggagaccttaaggaagcatggaaagctgcagctccctttttccaggaaaaggcagtcacccgtcttcttggaagctgtatttcagggaggcctctccagatgggctgggggacactgccaactgttagcatattgtccagacgacccagcatgagctatctaggtcatgttcagacagtaccactcatggtgttctcttgcttaaatcattgttcctgagtagccttgaatagtaacaaatgtgatatcttgacatcatctggtggttgggtgacaactgtttaattttctaacacagttggtttctgcaatgccttttcccaagtaatttagtattgtcttatcctgctatgtcttccacaaagggaagatgataaaatctttttaattagcataatgtttgtctactttaattttacattaaaaatttgttatacttttattaaaatactttcacagtaaagttttaatccattttcctatggatttttcattttgtaatatttctttcccatttataatcatataacatatacatttaataaaagtatatacaatatatatcaagcatatatggtatatatactataattttgtctgttttctactttctttctacttatgtctattttctgtattttttccatatggacatcatttttcacatttaatgtcttcttaacattacagggcagttctaattgttagaaggcctccttatactgatggctagtttgactcattataaagtcagttattgttcttggttttatgtcttaacaaggcatcccctcctcgaaccttagaggaattgatatctgacttcacatgctctaggggatgccatgtaaaattttgtagaaatgtttagtattctggcatgtgtgtctctaactttgtcagatgattagagatctgtgattagttaacaaccacacaggactgaattagcttccttccgtaactaaaagaattgaacagattgagtaaattaagtggatgcctcattagctccacaaagtttattagaattagagtcaaaatctaatacagggctttggactactaatatctgctagctacctttgggatgatttcagtatcataggatcatctgaccaaacaagctgtctcaaattcctgttagagtgaaaccttggctggacattagcttcacctgggtaatattaaaatactgatacctggccccagcctggagagattttgattctattaaattgccagagttagggttcaaggcaaggtacatccagagttgacaaccactggatttgaagccaaaatgtatagaatgtgaaacaggtaagcactgttggaactaccgagatagagacaaacacattccaggcactagcctctgcttctgtcttttctgatgtaagaatatttcgcctctcagaaagttgcttcccaaatgaatacttttaaaaattaacctggttttttcagtacataagacagggtaaggagaaaaagttcacctggtttttaaaaacactattgtttaaactttaacagaattatcttctcaaaatacttagaaatggagtaaatgtttctgctttgataacactgaaaccaaagctagagagtacagttaaaagggccattaaaaacagtttttattctataaaaataaattaatcatcgaatattcattataaattcaatcatgaaggaaaatacacattaaattatttatactaagataaatataaacctctattggcaaacaacttcgtagttaatttttctaatttaccactttctgcatctcatgcaaattatgtcttcttgcattgccaataaaatatgagattggggaaggatgctgcaatatccatgagaaagtttcatgtaagtgcaagcaatcagatttcattgcagatccagagtagtaacactgacagaactatgtcagttaagctttctgcattatttttatgcgttgtcattttcttttggcagaggagagattgaggatttacctggtccagaaatcgttgtaggttaacaaggtaccaatctgggtttgtttttatccccttgcttaaccaatcgtacagttaattcccaaaatgtgttattttttaacatgcaaagcagttcaacaacgatagaaggtgtagggattccagccacagacagagcctgagagaacaaacaaagcagattcagaaagcaggcaagtagcgcctactttgtttcagtggtatgtcctctgcagttcaaaatccttcagtatctcttaattaattcatagactatttccagtgaggtttcactgagaattccttaatgtcaagagctctctctgtatcttaagcagttagtgtcattgaaatttacttatgcaatgattctttcaccaaatatgtattgaaggcttatgatgtgcaagacatgtcccaagttctggtaatacaatgatgaacaaaattaatagtttctttctacacagtttttggtttatcaaatttattacatgtttaataaatgttcattaagtgcataaatagtaaaagaatcaaagatgtgatttcagcactatgtatcaaaaccacagaatggctgagtgttctttttaaatccatgtatcatagtgtattagaaggcaaaataataagaaagcagatcagaagtcaatatggtccagtaacaagaataaggagtcagattagagtcacattaacggttcacattttcctagctgtgggactgtaggtcgttattttcttgtcttattttgtctttctgtttttctttctttcttttctttttctttttttttagacagagtttcactcttgttgcccaggctggaatgcaatggcacaaactcagctcactgcaaactccgtttcctgggttcaagcgattttcctgcctcagcctcccaaagtagctgggattacaagcgcccaccaccatgcccagccatttttattttgtatttttacttgagatggggtttcaccatgttggccaggctggtcttgagcttctgacctcaggtgatccacctgcctcggcctcccaaagtgctgggattacagacgtgaattctataggtctcatttgcaccatctgcaaatgtgaacaatggtattgtgttcatttacccattcagccaacttttcctgaacatctcttaagtatagggttcagagatatggtaggttgggtttcagatgaccaaaataaagtgaatattccaataaagtgagtcacacacattttggttttccagtacatacaaaagttatgtttacactatagtctattaagtattcaatagcatgtctagaagacaacgtgcataccttaattttaaaatattgccttgctaaaaagtgcttatgatcatctgagccttcagcaagtagtaatctttttgctggtgggaagtcttgccttgacgttgatggctactgattgatcagggtggcggttgctgaaggtcagagaagctgtagcaatttcttaaaaccaggcaacaataaagtttaccacatttattgacttttctcttcataaaagacttctctgcaacatgtaatatactgtttgataggattttaccgaatgtagaactttcaaaattggagacaatcctctgaaacccaactgctgctgtatcagctaagtttatataatattttaaatcttttattgtcatttcaacaatttttatagcatctttaccattagtagatttcatcttgagaaaccactttctttgctcatctataagaagtaactgctcatctctttgttgctgagattgcagcaattcagtcacatcttcaggctccacttccaatgcttgttctcttgctatttctaccatatctgcagttaattccttcacttgaacccttcaaagttatccatgagggttggaatcaacttttctcaaactcctggtaatgttgatattttgacctcctcccatgaatcatgaatgttcttaatggcatctagaatggtgactcctatccagatttttaattttctttatccatatacatcagaagaatcactgtagaaagtagccttcccaaatgtatttcttaaataataagacttgaaatactctttgaatcatggctgcagaaagaatgttgtgttaagcataaaaacaacatgaatcttgtgtattgtattagtctgttttcatgctgttgataaagaaatacccgagactgggaagaaaaagaggtttaatggactcagctccacatggctaggaaggactcacagtcatggcggagggcaaggaggagcaagtcacatcttacatggatggcagcaagcaaagagagagcttgtgcagggaaactcccatttttaaagccatcagatcttatgagactcatttactatcaggagaatagcacaggaaagagctgcccccataattgaatcacctcccactgggtttcccccacgacacatgggaattgttggagttataattcaggatgagatttggatggggacacagccaaaccatatcattccacccctggtacctcccaaatctcatatcctcacatttcaaaaccaatcatgcctccccaacagtctcccaaagtcttaactcatttcagcattatctcaaaagtccacagtcctacatctcatctgagacaaggggagtcccttctacctatgagcctgtaaaatcaaaagtaagttagttacttcctagatacaatgggggtacaggcattgggtaaataccattccaaatggaagaaattggccaaaacaaaggggccataggccccatgcaagtccaaaatccagcagggcagtcaaatcttaaagctccaaaatgatctcctttaactccatgtctcacatttgggtcatgttaacgcaaagggtgggttcccatggtcttgggcggctccacccctgtggctctgcagggtgcagcctccttcctggctgttttcacaggctggtgttgagtgtctgctgcttttccacacatggcgcaaactgtcagtggacctaccattctggcatctggaggatggtagccctcttctaacagctccactagacagtgccctagtagggactctgtgtgggggctccaaccccacatttcccttccacagtgccatagcagaggttctccatgagggccctgccactgcagcaaacttttgcctgagcatcctggcatttccatacatcctatgaaatctaggcagaggttcccaaacctcaattcttgacttctgtgcacctgcaggctcaacaccacatggaagttgccaagcttggggtttgcaccctctgaatccatggcctgagctgtaccttggccacttttagtcacagctgaagtggctgggacacagggcaccaagtccctagcctgtacacagcatggtgaccctgggcctgacccatgaaaccatttttttcctcctaggcctccaggcctgtgatgagaggggctgccatgaagacctcagacatgctctggagacattttcctcgttgtcttggggttaacaattggttccccgttacttgtgcagatttctgcagctggcttgaatttctccacagaaaatgggattttcttttctatcgcattgtcaggctgcaaattttccaaacttttgtgctctgcttcccttataaaactgaatgcctttaacggcacccaagtcacctcttgaatgctttgctgcttagaaatttcttccaccaaataccctaagtcacctccctcaagttcaaagttccacagatctctagggcaggggtaaaatgccagcagtctgtttgctaaaacataacaagagtcacttttgctccagttcccaaaaagttcctcatctccatctgagaccacctcagcctggaccttattgttcatatcactgtcagcatttttgtcaaagccactcaacatgtctctaggaagtttcaaactttcccacattttcctgtcttcttctaagccctcctaactgttccaacctctgcctgttatccagttccaaagtcacttccacactttcaggtatcttttcggcactgcaccactctactggtaccagtttactctattagtctgttttcatgctcctgataaagacatacctgagactggggagaaaaagaggtttaataggcttacaattccacagggctggggaggcctcacaatcatggcggaaggctaggaggagcaagtcacgtcttacatggatggcggcaggcaaagagagagcttatgcagggaaacttctgtttttaaaaccatcagattttgtaagactcatttactatcatgagaatgctgcaggaaagacctgtcccccataattcaatcacctcctaccaggtttctcccacgacatgtgggaattgtgggagttacaatcaagatgagatttgggtggcgacacagccaaaccatatcatgtatccatcagaactcttggatgaccaggtgcactgtcaatgagcagtaatatatttttaaaaatctttatataagagcagtagttctcaacagtgtgcttaaaatatctagtaaatcatgctgtcaacagatgtgctgccatctaggctttgctgtttcaggcacaagcacaggcagaatagatttggtgtaattctgaatggccccaggattattagactggtaaatgaacattggcttcaacttaaagccctcagctgcattagcccctaacaagaggatcagcctgtcttttgaatctttgaagccaaacattgacttattctttctagttgtgaaagtgctaaatggcatcttcttccaataaaagtttgttttgtctacatttgaaatttgttgtttaatgtagtttcaatgatcttctggataacttcctatagctttgatatcagcacttgctgcttcactttgcatttttgtgttgtggagatggcattttccttaaacctcatgagacagtctctgctggcttcaaccttttcttctgcagcttcctcatctctatcaatctttatagaattgaagagagttaaggccttgttctgaattaggcttttcttaagggaatgttgtggctggtttgatcttctatccagactactcaaactttctccacttcagcaacaaggctgtttcaatttcttatcatttgtattcactggagtagcactttttatttccttcaagaatattacttttgcattcacaacttggctgtttggtacaagaggcctagctttctgtctgtcttgacttttgacatgccttactaagcaagcttaatcttttctagctttttatttaaagtaagagatgtgctgctcttcacctcacttgaacacttagaggtcattgtattaattgacctaatctcaatattgctgtgtctcagggatggggaggactgaggagaaagagagagatagggaatggccagttggtggagcagtcagaacacccattaattgagtttgccatcttatataggcatggcttatggtactcctaaacaattacaatagtaacatcaacaatcagcaattacagatcaccataataggtattaaaataattttaaaagtttgaaatattgcaagaattatcaaaatgtgatacagagacatgaagtgagcacatgctgttagaaaaatggtacccatagacttgctctacacaaggttgccacaaaccattttgttaaaaaaaaaaaaaaagccatctctgcaaagcacaacaaaacaaagcacaataaaatgagatatgcctgtttcagtcactttgctatttaaaagagaaaatctgttaagccatagtccttgtcctcatgattcttacagtttggactggaagaaaatctttaggagtaaagacattaaatgtgatgaatgtttttgtgttggccttttacctatttattctcagaccacatattgccctttctctgccctttatagttggaggctacgctctgaaggctgtggtctcaagacttccatgtcctttgttagatagatgtagcacattggaggcactggtggacatttggggagaggcagaaagagagaagccagagtgttttactctctctacctgaggcagcacctcaggcagtagctgtgtctcctccatggcttcacccttagctaggtgaccctaatccttgcatacatcagccctcctttttagctctagtccaggggcggtagttgcttcctgttgtttctaacccctaagttgcctcacagtcccctatttggcatttcaactcttccatcaccagtgcaatgaatcagatctattaaatacactacttttaaaatgcatagagtgtttcttttagcttagtcggaagctgtttgataaagccttgataggagtggcagaggcggatcttatgttagaagtagtcaatgaaggtttactgagaaagtaaaatttaggctaaaacctcaagtgtgaatataaatgtatcaatggagaggggaagaatattctagatcagaagtgtccaatcttctgtcttccctgggccacaatggaagaattgtcttgggctacacagaaaatacactaacaatagctgatgaactaaaaaaaagaatcacaaacaaaaaatctcaatgttttaagaaagtttaccagtttgtgttgggccacattcaaggccgtcctgggcctcatggattggacaaggtttttctagatcatgtgcaatgggaaggaaaatgaggcatattttagaaactaaagatgtagacaactggaatgtgacatacaagagaaagaaggtcaagaatgtttgagggctgtcaagctcattggaagacattacagtggaatgacatgggcatttgtgttttttaaagtcagtggctgcattgtatagaattacttgggatgcaagcagggaaccatttagaagattattacagacagcggtgttggtatggagcagaatgatagcagaggcaatggaggaaagtgagcttatctgagagatagaggtaggaggtggagtctgcatgtcttggtaattgagagactctgtgaaacaagattgaggaaagggttaggattattttcaggattcaaaacagagcaactgggtagctgaggttctaatcacagtgagaaggaatattggagaaggaagagttccatggttgaacttcaggtatatgtcggttatccccagggagagctgtccaggagtcaggtgcgctgtatgtgtctggagctcaggaggcagatgcagaccaaagaaattgatggggagctatccatctacagatggtcatagaagttatttgagtcaataaaatcaactaaagggggtgcaagattaggagaacaagagagtcctgtctcaagcctaagaactgccaatatttgaagacaaagctgaaatgaaagacatgaacagagacttaagaagaaaaccaagaaagttaggtgctatggaagccaaaggaaaggagtgtttcagaaaggagggagtggccaatagcttcagaaatgttcattggtttagtgaaacacaagtcagttggtgacccaatgggagaaatttccatatagtaggagcataaaccagattgaagtgggttgaggtgtaagtacaaagggagaatcaagatagtgaatataaacaaaattatttcaagaaattatgctcagagtgaggaggaggtaagaagtatctggatagggaagtaggaattgagagggatcttattttgtacagtgaaaaataagtgcttatggaaaagatttggtaaagaggaggaaaagagtaagggaaaaatggatgaagctgcgtatcagagaatgtgagaaggacaaagaaccaaagcacaggtggaaggatttgcccgagttggtaacaggagggaaaatggaaatgatgactgtgggagtagatgtgtttgtcattttgatggctggacatggagaatgttcctttttgatggttactattttctctttgagtaggaatatcatctgctgtgtgtgggaagtggggactcaagtatttgagaagaaagaagaaggacgtttgctgtagtctttgcagaaaatgaaagtgatttgattaatagttgttagaatttaaaaatgtgtgcacagtgtttgggttaaagttgtttttaaaaaaccagccaccttgccttttattctttatgctgtgaaacctctttagagcactcagtcaccttttggccactagatggacacagtgtactcagtgctaaactgctgacccaccaggttccttttgttaccagccaatactgacagagtgattgagttgtgaacttattgttatgaattgaaacttattttagagaaaaaatcttaaataacacattccatcttacttatagttcataggtcagagaaagactgtggtgctacaaaaacattagccaatatattatttgctttcacgctaagtgtaatgtgtgtaacatgctatctctttgaaattttttgccttaaaaatgctaatcagttggcacaaggcgatcatttacatagtcagaatagagcttttggtttagcattttatcttaaaataaggcagaaatggcattgctctggatgtcagtatggtgcattataacccaagtggtggaaaaataactgctaaatggcaaacacatagaaactgaattctgctagtcagcttccatttggtagagatatgtgtgcccttgggtagctgcaatgttagctattattaatagttcaaatctttgcttcataaaagttctgcatatagtgttgtacaaattgaagtgattcaaggaaatcatagttctgtggagcttcctccctgttttgtagtggagattgggaatgggggtggaccataaagtaggtggttttttttttcctgccactcttaactaattacacaccctgccatatcccccaccaacataagacttcagactgagaaaacctacataatttaaccaatgttagaatataggcatttttaacgtgctgaaaacagtgttgttcttttggttcctaaactaaaatcatttgatacatttctctgtcctatgaaggaagccatgaatgctatgagtaaagatatttgtggcaggtaagaagagggagttaagtaagggagtttaatatgaaaaattcatataaaggctccaaggttaaataaggaatacttttgcacaatgggttcaaggttttactgggtagagcatttttaaagttttataacgacgttagaaggaatcgatttgggagaaaaactatatctgcttaatgtgagggagcactgtggaaaatttccagcacaaacttttcctgggcctcaacatttcttggtaatgaacctagatttggagtgatcaaataatttgctgtctcaagtagtaaaagggggactattactaacttcacaagaagacaggcataaacccagcaacatgtacaaagcaggatgatctcaggtaactcaggaagatgctggaacactctgggtgaagggcattaatgctgttcacagtggaacacaggactgctaatggtatttttatgcttttatgcatcaaaagcattgttctttgatttgtaatctctcacatatgtgaagcagggcctttcaatctggatttggggtcagaagacaacatgtggatgggaggcagaaaattataacagactcacctggggagcagttttttgttgttgttgatattccctagctgctgggaatggtggctcactcctgtaatcccagtgctttgggaggccaaggcgggaggatcacttgagcccagaagttcaagactagcctaggcaacttagcaagaccccatctctacaaaatttaaaaaaatattagctgggcatggtggcatacacctgtagtatcagctactcaggaggctgaaatgggaggatcgtgtgagtcctgaagtcaaggttgcagcgattgtgccactgcactctagcctggatgtccttccacctcccccgccaaaaagggatattccaaaactacaacattctactacattattctacattcttcctttttactctccatattgatacagaaacaaaacaaaacacatttgagacttaccactgcaaaagagtgttctttgaattgtggctgcaattatttctgttgcaaactttagtgtattattgttataatgatacttgaagtaatacccagatgtattgaaaattcaaaagacttcattgccagctcaacctgcactctcaagcactgcttactaagggagtaacaatgggaagagacaggtgtgagaacagaccccagagccagggaaatgaacatggagaagggaaataggcaaaatctcctcatcagtgtggttgagggaatattggggcatggcatggagagtcccacctcacttggcagccagagaatcttaaagcttattgtcaaaaaccttatgaaaggttagagaaggtaccattttattttacaaaatactttagcctttaccagctcaacatccgtgtgtcagcctgctttgaataaagaaatacacgtcttcttaaaatctgcccctgactacgatgagcttctttgtttcagcttattttgactaattaggctgaggttacaaaccaccctgatatttcagttgctacagccacagtcttatttcttgctctcattacttgttcttggctggatgatattgatatgttcgttttgttctggaaccaaccctaaatgagctgcccatcctgagaaggcagaagaaattgggagatggcaggggcacacagtgattttttaaaacttctgtttagaaatgccacagatctcttccatgcacatgccattggccaaagtgggttgcaagatcagcttggtgtcagtggggcaggaagtataatcctggcacaataatgggcttggaaagctgttaaacatttttacaataacacaatcagattctttcaaattaattacaaaagtacttaaagttttttacatacattctgtgcactgtcccaaagctatatctaatgttacttcctcattccgatgaattactattccttttcttcttagctgtgtttaaaagcccatacatctatcctgtgataatttgtacactgtattgtgcttggtttacttgtctctctccttccctcagtggtgggcccttggagggcaggagcaatgtgatattcatccatgagacccaagtgtgtgattggtgcacaatggacaccctaaaaagtgtttattgataattaatgaattaatagctaaatgagggagtgttttctttaccttccctacactcaccttttctccattccagcaagcaatcttgcacatggagtagaaatcacagtggaatcttgaagaataactagaaggttaccagatgagaaagtacagggaggtaaatcagggaagaacagctgatagattcagttgtagccatgttgagtgaaggtaagattcttggattttgcttcatgaactcgaaagtctacataacatcaatcttggccactgccaagtctgacccatctcacagcaccagaggattggggtagtaaactgcagatgtagcacccacaggctgaccagtctgaccctcattaggttccccaaaaatcaaatctctaatgcacctgcatggatgctgcaaaggaatgtgcactaaaggaatgtgaaagcgataactatttttcattatttctgatgagacattttagcaattatgttaaaatctgcacaaccaaaaagtctaaacagagcgtgaacctctgacattgactctggaaattacacacattttgttttactattttaaaaacacacatgaaccgaagagaaaagaggcagaaagactggctagaacacagcagaacttacccattaatgtaatggagtttgagcctttctcaatgatgcctgtggggagctccgtactagtaatatctcaaggatattgccattgttcaaacatttcagggattcccctcttgaacttaccttcaaaagagcctttgctacatgtttttgaaattcattgatgacaaatctccatctgttgaaggtttatctagttctatgaagctgccaaaagtcctttggcattaagcctgatgattaaagttgatgatccagttagcgaatgctattttgagtcaaaatgagaagtaactataaaattaagaggcagttttcttatgcacactggaagtgccctgtaatgataattcccaaagagaatgtcaaaaatgtctttaatcctaatagaattcactatatttttttcattgaaataaatatttaggaaacattggtttgaatttgcatatggtatacatgtttgaagaatcactcttgttactatataggtaacacttataagtgttaaaattatcaagttacttaagtacttataatgaatataaataaaatgatccattgatatttgtctatatatttttatacataaaagattgtatatgttatataatatatgtgtatacatatagcacaatgaccaaattaaattgtctttgcagctatttttaattaaaacattttcacattacgctttcttaaacaattgcctctgttatatcagaagccaaaactggcaaattatattagctcagttatttagttactggggactctatctttaaaccaaccatgggaattcatttatagctactcaacactcaggtatgtatgaccatggggcagacaaaagactgctttaaaaatcactgatgtgtatcatgctttttcttcttctttagtatttctagccatcaaaaagaaattatattgtgaggcagatggcagtaatatatttttcaaaagtgaattatatcctgtttccccatataggtaggtaaataaataaataaataaattctatataagcaacatgacataattcccagactatgaatttctgctaatctgaagcatttgattaagactggatttaaactatgcttacaagttgccggaaactactcaaaaaggctacattctgttaactgtgttatttttgtctgtattatgtcaaataattttgactaaatcattggtattatcaaggtcatgtagaagtcttcttaaattctgattaaataatcgactttctttacaactacagacaaattgcaacagaatctgtattttcaggcagttcagcctgcatagggtcaatttaataccatataaatgttgggaacagaattatcagaaacttcagatatgtcaccataagccagatgaacaatatatgtcagtaccattgggggagtatttgccagcataaactggatatgtttcttgaatgcatgaaaaatgtggtactgaatgattcttccttcactaaaattgacttatttatcttgatttaaatataggcatacattggtaaataaaacctaggttttttcataatatattagagaatttttgatacataacaaatgaggtaattccagatcgattggaattcaggtttagtgcttcgtaaagagttgaaaatagttcctggtaggtaagtaaattgtggtgggaaggacaggacattctctaaaagtgcttggttttagagatgttttggttaagagtttgaccaggtggtagcagatttactttttcctaactcagttttacttgaaaggccttcagattaaatacttacagaaccaggaagaaatgtatctgagttacagaacttgaatggggattgtcaaactggagaatgcttgccccatctgaaggagatagctggcaatatgtagggaggggaactctaggtatttttgtttgtttgtttgtttgtttttgaggcggactctcgctgtcacccaggctggagtgcagtggggcgatctcggctcactgcaagctccgcctcccaggttcatgccattctcctgcctcagcctccggagtagctgggactacaggcacctgacatcacgcccggctaattttttgtgtttttagtagagacggggtttcaccgtgttagccaggatggtctcgttctcctgacctcgtgatccgcccgcctcggcctcccaaagtgctgagattacaggcgtgagccaccgcgcccgactgggaactgaaggttttaaacctcctaaacattcaaaagaagcccaaatctcaactttaatgtgacattttctgtgtgctttaaatgttggatcaaaaggaaaaacaaaattaaaaatatgttggacaaactcaggcctgctgtccatatttgatccaaggaggaccaatttacccactctatcctacacctttcaggtcatagcattttcctttgttatctttcggcattaatgtcatattccaatttttccatatctatgagcaaggcccaaggtctgtagccaagcccagggtttgcatgtgatatctttagaaaaaccccagagaagctttctcttgttttctcactatgctgtaagtatgaatagcccaaagcaaaaaagacaagtaccctgactatcatgatcttctaagtattcatggagctcgctaaaattatagttccctgtgaagagcgtgtcgttgcagaaaagcactggagagtgggcttagataccttcctgtttgatctcaatagtttaatgtttactagctcactgagaagagactgccaccttagtgttaccctcttgtaccaccctaaacaagtcatttatttctcttgttttctctctttaaaaaaatttccatatgaaattctgtgattttttttcccctcattacctattttctatcatcattgtatccaaaaggtcaagagagagaaaaggccacttctccattgactggttatctcttagactgtatgacagcaaaaatataagcaagggttaaatttcaaatgcatccactctgctcatacacatttgtgatttaaaaaacacacttcattgaataatttaaaatatggttgtaccatctgttcttgtggggattaacattgttcatgatggcaaaataatcacgttaaataaattctagatactgcactcttattattaataatagcaatgatattgttagttcagatgacccggccttttctgtctccatataatcacactattgattttccagtattggaaaggagaacgagagagtacatgcttttatttctaaatggaacatgctgttcaggaattctgccatttcttttatggaaataaaaaataaagtgcaaacatatgccatctttgaaggtaacattatgtaagcctttgagtataacatttgctgtctttatctatttctttgtgtctattcataagaaaaatgatcagattgtcaaattcatattctagaaactacgcaatcaattttttttcaggcattctgtcgtctgcctggaatgagattagcaaaagagtcgttgtgtaaactgaattagtttacttcatgcgagcattgattttacattccctgaactcttataacattttatgtttgagccacacagtaggtactatctcacattgactgagaatttattgtgtttaagtcatttcttctaaaaagtattgtaagctttgtgaggacaggggccattttatttttctcttgtatctgttgaaatttcccactctgctgggtttttctaaggtcaaaataaattagaattaagtgattgactttttaatgttgtatagtggtgggaaaaggttaaaaagagttgcttttcgtagcaagatggtatgggccaatgacttctaccaacaactaattcggtgatataaatgatatactcttagcttgggcttttcctctgtgaacttctatggcaattgggtgtggacaaatgggtccttgaagatattttgaaaatttccccaacaagaacccagtgcttaatgaccctctactgccaggtaaccttcctaggttgctgcacctattccctctgcttttctttaaaatcacatacttttatatttcctaagagaaggtagaatgtaataggcatcattaatttttgcagaaagtctccaaaacatgttgttaaatcaccgctgtcttcttacctccaggcaaaaaggtaccaacttatttaaatatttgttcactcacattatgtgctcctgtgaattttctctgggtgtcactcttcacagtgagtatgagctctcatttaatctctttcaagggaaaatgagctcaaagaccctgatgttgcaacttgacctccttgagtttgtattaagctgttaacttgctgatttgtccctagtttatctattatgaaaacttggatgttgtcaaaccacattttcattccccagtctgtgttcactatttgatgttccccacaagttacactgccttggtctcaactaaattggttttctatattacaaagtcaatttaatatctgaatgatcttccaagatactgcctataatttcttttacttctctctcacaaagccttatctttcattaataaaaaatggtcccaaagcccattgttatcatttgcatttcccactttacacaaaactagccataatctcactatcacttgtctggtaactcaggaatatgctgtataaatagtgtattttttattttggtaaaatatttgcaaaagtatcttgtggtagctataatggatgtgtgaattggataaaaatactattaagtgtgttttttcctagttgaacaacatagataaagaatactgagtaaagactaaatatttgcctggatggaagaccgttcatccaatcaaacaaatatacagaaacataaagagatagtaaatacactggaatgcaaagtcagagtcaatagttatttaagcttgctaataaaaatgactgcaatttcaagtgcacagttaattagaattggatggtagaggcccaagggtgatggcatgtaaatgaagaatatgtgaggaattctgtcttaagccttattcatagatgtacagcagagaaattaagctgactgacattctgtgccctgcaatcgtcatatcacacctggggtgtgggattcatttcagataccacaggttaagaggaaatcaacaaggagcaatcagtccagaagggtgttgccaggatggtgaagcatctgggaatcatgatgtcttcggaactgccaaaagaaccgagactgatgtggcctggaaaagggagagaataaaaactcctgtttagataatctgaggttttcatattaaaaagattcagggccaggtgcagtggctcacgcctgtaatcgcagcactttgggaggccaaggcaggtgtatcgctggagtccaggagttcaggaccagcctgggcaacatggtgaatcactgtctctcctaaaaatttttaaaaaattagcttgtgcagtggcccatacctgtaattccagctactcaggaggctgagctgggaggattgctggagcccaggctgtggaggctgcaatgagccgagatcacactactgcacttctgcctgggtgacagagtgagaccctgcttctaaataaataaataagactcaggcttgtttttgaatgactatgatcaaagaatagcacttttagaaaggtgaaatttagtttgatacaaagaacttttcaatatttaaatcttcaaacttttcaatatttaaattttcgatatttaaatctgctcaaagataagcatttaaatctgctcaaagataagcataccatgaagcagggctcctcatgccagaaccagatatttgtttttccttcaaggctgttcatgcattaggggaagactgaatttcccatggcttctaatgaaccttttaactatgaggatctgttacatgaaaattttttttttcaagatggagtttcgcatttgttgcccaggctggagtgcagtggtgcaacctcggctcaccacaacctccgcctcccaggttcaagcaattctcctgcctcagcctcctgaatagctggcattagaggcatacaccactatgcacagctaattttgtattttcagtagagatggggtttccccatgttggtcaggatggtcttgaactcccaacctcagatgatctgcccgcctcagcctccccaagtgctgggattataggtgtgagccaccgcgaccagtgttacatgaaaaattcttagaatagtgcttgatggcaccaagtaaatgttcaatagatattagttgtaattgttatcagtagtgactattctatgcatttgtaactgattattttttggatgggaataagtaaaggtgtttaaaatgttagcaccggtttctgttgctaaataattaaggtagttagtaaggtcttaggctacttgtaactaatttactcttaatttgtcaccactttatgttttccattattgcctttacattctatgttacctagatttgggattaattcatcaaatttaatatgaaaactttaagtgactgctaaatcacaattgcatatattaaattatctagtgataacgtagcaatagtctatcaagaaaggaatgaatcatgaccgaaaaaatgaatctctttcattaattaagagagatgtttcagtttagaaacttacagaatcttaatggttaagctctaggtgacgttagcttcattggattattttctcaggtgacagatttgctacatcttaggatggcagctaatatctattgaaggtattcattcattcactcacttcctaatttatttaacaagcagtgtaccaaccactgcccatgcctgcacctagctgcttacctctacagagtgttttctacccttttatccctttttgagtcagtcatcacaggaagaccagcctctcagtcatcctatgtcccctatatcccaaccccaagggctccatggcagcaaagcagtccctcttctcaccccatccctgaactccttgggctccttccctgctgtattttcctctgtatcagttatcatttctcttatatattttacttactatgtccatttacctatctctactggaatgtcagctccataaaggcaggaatatttgcatgtgttctatttgctactgggtacccagagcctagaatagtaacttgataaatatttgttgaatgagtgaataaggcctaagtgtcatggaaactgataccagaaaggtgttatttcttccccagggttaccgaagccatttatggcagcgcagcattgtgacccaaagtcacttggctctgaaaccaacatccccattcttttttttttttttttttttgacagagtcttgctctgtcacccaggttggagtgcagtggcacgatcttcactcactgcaacctctggctcccagggttcaagcaattctcctgcctcagcctccgaggtagctgggattacaggtgtgtgccaccatgcacagctaatttttgtatttttggtagagacgaggtttcaccatggtggtcaagctggtctcgaattcctgacctcaagtaatccacccacgtcggcttcccaaagtgctgggattacagatgtgagccactgcacccagccccaacatattcattcttgatctctccctgcaagcaaataactttgaaattatgctgaataaactcagggatctagagatatttgacaatgacaatgatatttcactgctgtatggatttaaatacaaggagacaacttttgtatcatttacatttaggagaacattcaggtcaatatttgcctgcctaatttatctccatgtggatcacttttgtttcttttctagatgtattcaatctgatttagtttattatgagtttctctattatttgtttttttttccttggatcattgatgcagaccctagaagaggtggagtacagaaatagatttggagaagcaataatgagtaagcctcagtctttgcctctgagatgcattcagaagtggttgaggcaacattgtaagtgtgcagttccagagccagaagataaccagataatttataatccaagcaataatattgcaaaagtaaaaggaggcactatttaatcatcattccagggcaatagctgtatactattcagacaaactgaagagtaaagtcccctagtttaaaaactcgacaaacgtaaaatatgcttgcacatctttttagtaataaatatttaccttgcatctactattttcagagacacatactaggcactgtagcaatatatatagaacagtgtacagggcactgtggtgaatttaaagacaagtcatatatcttcctatcttgtggttcagaattcactttaggacagagaacattaaaaatacaataaaaagcagtaaatgatggtgcaagctgaattaagcttgatgtgatgttagccagccacaaggtttccaacagaattactgatatgatttggctgtgtacccacccatatctcatcttgaatcctagttcccattgaattatagttcatttctataattcctatagttccaattttatagttcagccaacaatccccatgtgttgtgggagggacccggtgggaggtaactgaatcataggagcagtttcccccatgcagctgtcgtgatagtgagtttctcatgagatctgctggttttataagcttctagtgtttcccctgctggcactcattctctctcctgccaccctgtgaagaggtgccttctgccatgattgtaagtttcctgaggcttccccagccatgcaaaactgtgagtcaattaaacctcttttctttataaattacccagtctcaggcatttcttcatagcagcatgagaacagactaatacgctgatgctgtaccacttttatttctatctcataatattgtcaattgaaatcagtcctgtcttgatgcatgaattgcacatcaaatgaattgtatgctttttttttttcctagataggagttatgccatctacttcttgtgtgtatacatagtacatgctcaattaatgctggctggctggttggggtagaaaaatgaattgatagatttaaaaaagtcatctggcaaccaaatatagagccttgtttgccaaagacccctcctctttgctgaactagctagttgacagagtaagaacttgcagcatgattattttttatcttacaactttataatgatacatttggttatttggaaataagtttaaagtgttttaattctttccactggttcctactgttggaaattcttttgcagctgaatattggcaaccgtttgtatcttggcaagtagactatgctttttaaggatgaaagtgtgggaagtagtataggacatctgtcgaagaagtcatgttgtcaaagcctgttgtgtatattaaactcatttgtttccatttctatacattctaaagcaaaatgccactccatttaacattcaaacagcttataaagagcttggaaatatgaattgtgtgggcctacctgaaatttcaatgaatgagcatcattttattcagttggttttgttgctgctttagctcagcctaaactttggatatataataggtttgttgagataagattaccagtagctaagggcttttgttggatgggagaattgaaaccagcataatttccggtacctgttaaatggcacttggaccaggcctaatttactgtccttgtatttaacaaagcagaacaaacaaaacttacttagatacctgattcactaacttcctcttctaaggtatccgtccatgtggttttctcctttacttaagtaggtttaataaacttgcctttatgtgaccaacgggtttctgttgggttttggaggcaatgacagttaatagtaaaataatattttgagagaaaccgctctcaaagaggctccattagctggagaataaagcatttttaaaaagatgagaccttatgcttcattcatctcaaacttacctgcttataaaaacaaaacagttgattgatttgatcaaaagttatccttgttataaaattaagtgggcctgctgactagctgatttatgggattttatgttctttaacttcgaagaagacatacaattcagtctcaacagtttttacaatctgagagattaggtcatgctaataaaatttctgagaaactacttatccatctgaatgttaacatcttttactagaatagtatgtttgtttcagttgatgaagacttttgtttggatgtaagctttcaactcatttagataaataccaaggaagtttttcaatatcattattttaatggattcatgatattcacattgattggctattccttattttaagtagttgggcattaaagatatttacatctttttattattttgtaagacactgtgatgaccttcatgatagttaaatcttcatttgcactgttatttccttctgactgtagccattgtgtgtaagactgcaaagtgtaatatatgcagtgtttaagagtagattaacaagaaaagctaatgtatgaacataagtagctgacccttaatagaagagtgtttaattaattttgaatttgccagtacactctcaaaacacagagcttgattaaataatggcattatactgagcttattcaagtatttggataacttttctttactgaactgaaactgatagcccaggcaggcacatctccaacacctctaattaaaatccacattcatcccttgcttcctgagaaaagatgttgctctcatgttcctttgggcactctttgcaaagtatttctgtttgattgcatatgatgaatagctccactacttccaatgtatttcagttgtcaaatatttataattattattcttgggaaagtaactgagaagggagttcaggaaagacttggacagttctttggagcatcaggaccttacaatttcagctatcttgttcaataagcaaatgttgttttaggttcctggattacaaggtcaaagaaggcagaattcctgccctcaagaaaagtcatggggaagagttgtaaatgcatgaacagctatgaaacagtgtggtaaagtcatgtgagttggcaaaatagatgagaggcttctaagtaaaactgaggaatgaagaatgttttttggaagagattacgcttaaaaggaattagccagccagagaagaaagagaaaaatgttcttgccagagtacctatcatttgggaagccccagtgggccagaagaacagactgtgtacaggaaagacactaccaagtgttatttgtggctgatacaggagaggaagggagagcaaaacaatagagcatctctgtgctgagtattggaatttaaattttgaacttcattactaaataatgtggaactattggataatttcaagcaaaggactcacatgttcatgtccttgcatgagtttgctaagatttccattttaagataatcttggtaggtaagtgaaggatagatttgaggaggaaaaaatggaaatattaactctaggcaaaacatagggggaaagataattgagagagattaaagaatgtgtagagaggtagaagatatagtctggtctctggaatcagatgaattggttcctaactctgactccaccacttaacactctatgtgaccttgggtatatatcttatccctcagtgtcttgtttttctcatctgaaaaatgagtataataatagggcccaactcatattttatgagaattagtcaacctgccaaccacagtgcctagcacattgaatgcatctgatcagtgttagctattatctattgactattaatattattgttactatcaatagtattcatgtctctagggtttgtgacctgattagcagttattgtctggttattggctgaatggtggccagtactagggaatataagaagaaatgtggggagagggagtggaggaggggaggaacacagttgatttgaattacattataaatgctcaaatgaactagctatggaacttacaagtggaattttctcatgtgcagctgatggtaacagcagaaaaatgtgaactctgaataaagaggtgggagtttttcagcacataaagaatatttaaagccaattcattggatgcattgaccagtaagtgtagagatcaaaatcaagaacaactccaagaattgagagcagatgcaaaccccaatttttgtgggtctccagtccaggtatgagcagaaaacacgagggttggggagggaaggagtcttccaagccataagccaggggaaatcgttcagtcaattcttatgctctgatgtggtcattaacagatgataacctcatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagatgagacttctttaggaacatcctaaagaagttcctccagcatttaaaattgctaaacgtaggccagggtagagttaaaggctgaaagaaccttaattaatatgtattattccagttattagaagaaaagtcctatggattgaaattgctgcttgctggcaattacttttaattgctgtgcagggcattattaacgttgcaacgtctagcatagtgatgaaaattgatgttccagatgctttcatgtgagttctccttttcttttaatgttctcaagagcatagaatcatggggatgataagtgagatttttgctagactctatacctgtcttccatagaaatcccagtatgcaaaaacaaacaaaacatagatgggtaatcatggccattccttaataagatttgagccttatttggaggtaggcctggtatggatggtagctctaatctttagatgaaattaaactctccaatgtgttcttattttcctaaagatcaagtccccaactacctctctccagccccagagaaagggaattgttgacgatagaaagattccattttcttcccttaagggccacctcctgctagttggccagagttctcacagactctgaattcttggcaggctggagtttaacagtaatcctctctcatccaaatttaagtacaggtaatccccaggagcccctgccaggcttttggtaaataattacctgggtacaagcaaaaatgcccctgctaagaaaactctggaattttacccatcataggacacataggtctctaccatagaggtttatatcttattcttcaatttctgattgttacccctcctaggaaattcttatgtgaagcaaatcttattctcttctactgggcaatctcctaaattagctggcatgtgaaaatgcttcattgagcttttgttcttcagactctcaaatgaaggagtatgtccaaagagcctctttatgcaaaatctacaaattacaccccagtcatacatcacaattagttggcagtcattaggcattacatccatattgtaaaattagtgatgtttctcccaaattatgaaatattattcccattaagaaaaatatactgaagagtaaaaacataacagaatttttgctatatttattctcttcataattatgcaaattaataaaaattatttactatttactaactttgcattgagtgttctctcattctgatgagactccagacttctgccttttgtacacctgtgcaaagcctttctaagctgtttatttatgtcccaatatatatttcagttcagaaaggctgttcttacttttgcgacaccttaatagtagttttatttcatcaaggaactgtatgcaatcactggatatttcagagagctgcctaccttattttcatactataaagaaataaacttgaataacaatggatagtcttggcaggagtgtggaggagttgacatcttccaacatgactgtgggaatatgaactgccatagcctattaaagggaaaaatgttcacaatttgtaagctagcaatccattttcagaaatacaagcaccaatcagtaagaatatattagcaaatgtgtttattgtttatatgagtccaaaattatatgtccgtcaataaaggactcattgaataaataatggtacatttatgccatggaatcttatataactattgaaaagaactcactaggtctctgtgcattcacaaaaataattttttcatgattgacttaatattaataaaggattatacatagtatgagcccactttattcaaaaaggaaggagaatccctatacatgtgtgagggtttgtgtattgtgtgtggtatatttatatttgtataaataaaaagtttgctgtcttttccctcccattaatcctaccaaggaagggaaaagacagcaatcttttttatcttcacatttctgtgtcatttggcatgttaaaaaaatagcatgtataattttgtaattgaaacctaaaatataagaaagaaaattattgaatagaaatggtaaatactatgcagccataaaaaagaatgagagcgtgtcttttgcagggacatggatggaactggaggctattatccttagcaaactaacacaagaacagaaaaccaaatgccacatgatctcacttacaagtgggagataaatgatgagaactcatgaacacaaggaaggacacagaccctggggtctacttgagggtgaaggtgggaggagggagagaagcagaaaaggtaactattgggtactgggtttaatatctggatgatgaaataatctgtacaacaaacccccatggcacaagtttacctatgtaacaaaccttcacatctacccccaaacctaaaatacaagatttaaaaaaaaggaaaattatctactctttcaaacttaaaatttctggattttaacagtgtctgctgtttaaacccaaacagtgtctgaatttggctactgaagaataaaatgtagccctttttcagcacactgtatgtttacccaggtcccaggatgcttaaataaactggcgtgtctattcaaatcctggataagaaataatttttcaaaataaaaattatctcacagaatactctgaacacctgctactctcattaccctgaacacttgtggttttgttgctataactctagcaaatggcataaaggctagaaaaactgtgggataaagatacagcatttctctaagaccctgctgccttcagtagaattatttaatatcctttctaatttctccaacttatttttcactgttatgaaaaaacagcttacaaagaattagtaacattcactatcaatgattccatagatcttcgttcaaagtgcaggtagaaggtgcatttctcaaagagtgttttaaacgaggaaaaaaaatgtgtatcatcatcaacgttttagtgaataaagacattgcttaccgtttttatgttcctgagaggctaagttcagttctatcatgaatagtaatttatgaataagaacccacaatttttttaccagagaattggaaaaccgcccataacatttccatatacccatctcattttctaagtatctataacagtttagtgaacaatattccctcttcgaaaatatagcaaataattatttccttcctatcagatatgcatgctttgtttacaggtaaataactctgattaccaaactactattacattaggttgatgttcttttcaacgttagacaaaaatggataaaaccttgctgcctactcagagatttggtctgagtggaaataggcttttgtggagctacagaatttctgctttatctactcagccaataattggtcagagcatgagcctggttagaaataagcaaaaagcttcttgtatccatgaacagaatgaacagaaaacaaggtagtacatttagcctccgagaaacacgcgtttacttttgaagcaaagaagcaccgggcaaccagtgagcagcatatgtctgaaatctattatctgacatgttctttccagccttcccaggaatgctggtctgactactcagatttgcttttacttcttgccttttggatataatgagtttgccaagcagctgtgagtacctgactctggggaaggtggctagattccgaagcgcttatgttcatggatcaccatacgcgatcaacatgccaattgatattaagccacagaggagacggtaactgctttcctttcctctagttgtttgtcagtgaaaatgtgttttgttgccctttggtaactgctttggatgtctgctgaaatgggagggtcagggtgagaagttagtttttattcaacacactggatagttgggaaaaaaattaaccagagaggaaagctggaaatagtttagctatttagcaaaagctgatctggtttcaaggtctgtagattttaagaatttgagagattgtcagtgcttgtattgccatcaaaatcacccatgatgagaatttgaaagaggatttagccaaataatggatatatttattgatggctatatggctgtttataccagatgcccagtaactcataatctacatgtgacattccttaatgcatcataacacattaatgcaataaatgagttataattctacaaaaacatttgttttcctgtagttgctagggagggaagaacaaggttatgtatttttcctataaaaaagttgtcattttagatctgtgttctacccccgacccaccctttttatgtagtatcagaatagcgatgatatagttaactaatatgtccaaaagtcacccctcaattttggttttatacaacgtcattttcttcagcaattaacaatgaacttcagaagcatttataaagatgttccattctctctgtgaaaattccatttctccctaattttatgaatccacataatgaaaatccaaaattctaaaagcaatgtattttacttggaaactgtcattactatcttactcttctacttttctttttctaattatatctacacaaactcacaaagcatgcattttgccagatttcaccttattataaacatgaagggatgtttaagtgattaaaaagtttctaaaccttcagaaagctttctgatttttgtgagacaatattttattcttttctccagagtatcaaggcttttctgtccagctctatcactatttgactttatgaccggctagcagcaccaagcaactattttaaaatacattcagaaaagtgtgtcctaagacacccaacatggctcagttgctgtcagttacctcattcccttctttagttggtgggacgatactacaaatccatacaagttgcaaaatccacatgaatatctaatgtccctgttcatattaccttaatttttctgctttaaagtaatcaactttttgtacaagtcagtcaaattatgtttttatgtatattgtgtatatgcatagacccagaaaatttcagacatatacctatttaggcttaaaattgggcatcacagtgtattttacaagaaaatatatttgaaaggcattttacaataattagtatttaattgtataggtcttgggatttgtaaaaataccagatccatcttttctttcagtagaatacattacttacctatggctagtaaatcaattaaataaattttatataaaaagttaacttattacatctggagctttcattctacgaaaggataaatatgacaacaaacatgtaatgaaaacaatagttagaggggtggatgaatgaatggaagaacatccaaatcatagaggttgtctttttattctgttactcattttcttaagttgtaaattttaaaacctcaacttcttttgaatctgttgagaaaacaatacacttggaatggtgagtcatcatcttagattcactaaaatctacctaagttttgaatggttctttttcagaatgcttgctgggactaagatttatctaaagtagcatgtttatgtttattttcatatcatctcggttgtggtttttggcagaaagaaaattgttttctaattacttaaaaaaatctgaggaaggaaggatggaagggagggagggaaagacatctaaagaagagtagctatgagttgatatttcagcctacccaaagaagcagagattgcgggacaaaaaataaaagataaaaaaaattggcttttcacgaaaatccatagagaaaatgaagtaggaaatcaaatgcataagtgcaaaacatagctcgatttaaagctaagtatatccttataaaataatgacttcttgaaagaacagcatgtttttcttggaaaacagggaaataattcccaaattattagaaaatcacctagattagacacatgaccacatgatcatttaattggtctcaatttttatttcaagagcagcaatgaagacatcaagaaagcagttaacatactaaatcttaagtaaactcaatgttgacgagaatgacaaccctaccatctgtgattataattactttctatatttgcgatttaaaaatgttttccttttaatttttggtagcctctgtaaattgtactgtcccactttttcttttgtaagaaatataattttctttcaattttatgaagcttttatgtctcaattttagtatagcaatttcttttttttttttttttttgagacagggtctgtgtctgttggccagactggagtgcagtagcaatcatagatcagggcagcctagaactcctgggctcaaatgatccacttcagcttaccaagtagttgaggtcactgtgccaggctaatttttttgtttgtttttagagagactgggtcttgctgtgttgcccaggctcttctcaaacagttggcctcaaatgaccctcctgccttggcctcccaaagtgctgggattacaggcatgagcaatcaagcctggcccttcatacagagatttaaaaatcagatttaatctggctcttctaacccatcctcacccaattggactgtaaagtttttgagtgtgtggatcacgtcttggttgttgttacttccccagtgtccagcatagagcccagaacaggttaaataataaatgtttgtttaataaataaatgattagaaaatgcatggtacatattttggcataggggcgtgtgtgtgtgtgtgtgtgtgtgtgtgtgtgtgtgtgtgtgtgtgtataaaatcacttccctgtatgccacagtatggagtctttggcaagatttttgcttctgttattcatttggatcaattaaattccctttccttgtttccctgtagaaactgcatgtagcactgactttagattactggcttaagtggttggggatcatgcattttgtcattaccaggtcagcaaaggagaacctgaaataattcacttctgtattcataaaagtatatatttgtatatatgtaatgtgtgtgtgtgtgtgtgtgtgtgtgtgtgtgtgtgtgtgtgtgtgtgtgtatagcttcaagttgtagaaaggaggagaaaaagtcactgtgggaggtggcagaggggaatttcctagagggaaacaatactgcaactgtaagaaaatgtaagaaatttgatagaagcacaaaatttcataaaatcagttataaaaattatgacatataagccccagttctgttgtcttgctataatgtaaaagtcacatttttttttaatcaaaatggaaaataaaaactagtagcagtgaatgtggtgagacagtagccactggcaccccaaggcaatggaaagcaagtgcccttgagcactacttttcacagccgggtgtcatgttttacctcacccagccgccttcttccctgcattttggtggcttgacaccattactgtcggggcagggtggggtggtaggggggtgcttgtgggagtgctggtgagggtccttcccttgctgcctgctctgtgctccctctttctggtgatgcagctgttctggtatactctctggcctctgtttttctaaatcctttaggtaggcttgctctccctattatcgctgggatcagaaaaaaagcagggtacgaagatccagaagacaggaaggaatacagtaagtgtgagtgaaggtaaaccagcctgctctcttcttgtggaacgatcacaaggtcatgcacttagatttatgaccaatcatcaagctattaatttactcaaatggtgtattaatttgttaggacggtcataagaaaatactacagatttggtggcttaaacagcagaaatttgttttctcacaattccaaaagctgtgaaatccaaggtcaaggtgtcagcaggtctggcttctccttaggactctggttgtcttgcagatggccaccttctcactgtgttatctcatggcctttcctctgtgcgcaggcatcgctgggatctctgtatgtgtcaaaatttcctgcttttataaggacatcagtcagactggattaaggcccaccctaaaggcttatttaaattttaatctcctctttagtggtcctatctccaaatatagtctcattctgagatactggtatttagggcttcagcatacaaattttggggtagacacaattcagcccataacaaattgtgctcatgaaatgatttactaataatgattgtggagagagatagtaatccgactgtgaatcctgaataattagtggcttcatgttcataaaagtggactcaataatgggcatgaacctgcacgagggaggcattgcggagaagaatacgtcccattttctgtaccaaagaaaaacaagtacacattgcaaacaataaatctttatcaaattcaaccaccttattttgaactctataatcattcaaacgtggcctagactaacatttgcttttttatagcttttatcaagaggagtggaggtattaaaattattattgaggggtgtagtgattttcaactgacgcaattctaccctccacctctcatgcaggggacatttggcaatgtctagggactttttttattgtaataagtgggaagtagctgatgatttcaagtaggtaaagaatagggatgttaaatctcctataatacacacgacagcctctcacaacaaaaaattatttgacccagaatgtcagtagtgctaaggtggaaaaaaccttatgtgaatcaattaaatcagggagaacttcagagcttttttaagacctttatttatatctagatgattgatattttttaggtattcatgaaaatactttcttttacctttcttgtggtaagcacaagataacactttcttgcctggttaaaaatggacaactgctacacttttaaaataatataaagcattcagtaattcaaaccatcctgtcttctgatttgtctgaattagtgtggctttactgcattttcagggcttattattctttcagtagggagactactaagatttcattaaagatagctgaataaatgatcaaatacattattgtagctccagactaggtaataaacattgagatatgcttttcaagtagtggtgaaaatactaggcaaaattacacatacacttacatatattaagcgaccatcctgttggcctggtatgtgaagctctgctgaactcttgcctaaatgcatggacccatcgattgtgaatgtgtgactacttgtgtgttttcatcataaccagctcatcctaatagcaaatgatatggtttggctgtgtccccacccacatctcatctttaattatagttcccttaatctccacatgctgtgggagggaccctagtagcaggtaattgaatcatgggggcagtttccccatgctgctctcgtgatagtgagtgagtactctgaaatctgatggttttataagcatctggcatttcccctgttggcactctttctccttcctgctgccctgtgaagaagatgcctttcttcccctttgctttccaccatgattgtaagtttccagagaccttcccagccatgtggaactgtgagtcagttaaccatcctttctatataaattacccagtattggatatttttcatagcagcatgagaacagacgaatacagcaaagaacacgttttatgaaggaaaaactttgaaaacaaagggactactttctttgatgagaggcccttcctttcactttaaacaaaacttcaaattatcctcagaatttgttctaattctccctacttctgggtaaaaattattagcagtaacagatttaacttgaatgtatatctccagttccccattctcttctctatgtagtgctgccaaactcaatagatttgaaacaaaaattacccagggaccttccccatctcccatgtccttttttcttatggcccagacctggaagtcctcctaagtgcttcctctccctcagcctaaccactctaccactatccagttgcaggtacactcttcctccttcacctcaccctttgatgccatctccactgctaccatcttgggtccaaccctcatgttatcttgcctgaaaaccgctaactttataactagtctctgttctatcaacatcctcttcctgactgtcatccacagatccactttctaaaatgccatcatgacgcttccatgcttataccactagcttttcagtggctaccaaaaaaaaaaaaaaaggttacattcccagccatcatgatctattcccttccacatctctgcatccttgtaaattgcccttgtcacccatgtatactgtgtattttaggtataaataactactagctatacctattttttgcctagagttccattctctcctcattttgtgatgaatcccatcattccacagatctttcctagaagacctttcataattttctatttccaaatggaagtgcctccttaactagctgtttttcttttcttctgtgtctgttactgcactatcataataaatcttaatttatatattttctatctttcctcctccctaagagtggcatgatggaaagagttgtttcagaaaaaatttggcaatggaatgctgcattaattggaatggaaaagaatgaatccctacaccaacagaaggaagcagtgtgaaatcctgacagggacaatttcattacaattacaaaatacataaatatgtgattacaattgtgagaactgctcaaaaggaaacaaggacccagtgagagtataaaaataagtacctaacatagtctgagtgtttggagaatgcttccctggggatgatgaggcctgaggatgagtaacaacatactctgctgagaaccacatgaatgaagccctgatgtgttaaactaaaaggataaggtgtctgaagtgtaatgaggcagagaggagagtggcaaaaataaactggagaagatgagtaggggagactactgttttcttacatgctaattaacccaataattctttatttcattttggagagaaacaagtgattatttattaatttattcattggcaatgcaatttaaaaacatattctttgtgtcttatttatcattgaggtttttaaaacattgaaataaacaataggtaatattttccaactgagatttaaaaaagaaaaaggtcagttttcaaatctattcccaactgctagagtttaataaaaactgtcataaatgttgacctttgttctgcaatcagttcagcatttatccatcacccaaccatgcagcctctcgcttgccaaaaggagtggaatgagaattgttagagtacttggaatgtttactgtcagcaaagtacaagacactacacaatcttgatgacctttatatgatagtcccatttctatatccaataagagacattaaattacttaataattctttggaactttctttttagtttttcatggctttgctcttaagttgaagaaaattattacatggatgaactacaaacggaaagcttctgttatcaccttttatcgtactttgtaaactatgataaatgaagtggcgaatgctgacaaagcattccaggctcaggatggcacctttcaaaggcaaaagaaggtgaacaatctactaacagcctttgaaacaatagtcaggactttggacttggcccataatgttgtgtttcatattgccctaagaaggttgctctaggaaggaaaatagtttagtggtgatggagagaagggcccctaagggaagaaatttgatgagaaggatgttacaggtgtctaaggaaaaggtaatcagctcctcagacaagatggaatgtgcattgaatttgaaaagatggtcagtgcttcattcatgtggttctcagtagagcatgttgttactcatcctcaggcctcatcatccccagggaaatattctccaaacgctcagactatgttaggtgcctatttttgtactcttactgggttcttgtctccttttgagcagttgtcacaattgcaattacatatttatgtattttattggcctaagggcttcctcccacgttcaatcataggaccatggaaacaaggttgaagcctatgttttaaaccattatgtgtctggtgctttgtctgggtcctggtacataatagatattcaataaattcttgtaaaattcattttttttcaactgagagtacaaaagtaatcagacagtaaatatatgtgtacccttttggagaaacattaaattcattccattagcaggcaatgagttctttatttaaaaaaaagttctttcagcaacttccaaatgtacatctcaagctctgaccactcctcccctttagactcctactaactgcttggaaattatttcagttgttctcatggccaaaattgaactcatcatcttactcttaccatctggtctttttcttctatttctttgttggattgattactacagagttatctaaactagaaacacaggagtcaccttagtcatcttcctttatcttaacactgtctctcatcatcaagtcttcttttacctataatgttcttatatgagtcccttccactctgtctttattaatattgccaactgatgtgaactactgtaagagcctctgaagtgatctccacattgctggttttcatataatccaccccaaaggtctttgtgtttgttggttggttttcattgctatagcaatattcacatttctgcagtactagtaaattacactaaaacgtactgtgttttataattgacctcgagtataaacatacaaattctactgctctgatgtttctttctaagcaatggttgaatcaaaaaacaatgaatttgcctaattttcatgatgaaaacgttcaaaattctcctaagatttcttgaaatccaagcttgtgattgtatgagaattcacaataaaccagctcacaaaatgtataaacttcagtttgtcatagtctatgaggaattactgaagcatacggcatttactcattgatttttaattcaggcaaaagttagaaatacacaaacacatacgcgtacggaggtctcaaagtcagttgtgcgataataaattatttaactcacccttatgataggtaaacagttttcctaaatcgccctcctgccccctgctaccctgactgaaaatatgtgctctggtttgtgctgttatttttgaacaatgtatgccggtatccgatgtaagatgattcatatgatactggtgttaccatggcaatccatcatgtatatagcaagaacactgtgaataccagcagctctttgttctcttcaagtttccattttcttttcttgtttttttttttttttttcttgtgcagtaatccagtggctatgacatcaagagtaacacaatctaattttctccttctgttgcttgtggtaggattcatactctgctagcaagggagttcttggccattttgatttgcaagagattttgcttctccctgatgtttcatttcgtcagcaaagtcttccctctggggaaaaacccacttgaattctaaggctgatagatgctgggaatcccatatgatgagtcctgtggaagcaggacattccagccctggggttgctgttgtctctgacttcagtatatgttcaaagtcatctcaaaataaagtaggaagatgagtgttaacctgcacatcactggcagtttttaaaggtaaattgccatttttacttaccacactggattctccaagtcagactaggatttgggttacaatggggatcattggggttaaattacttaagggataatgagatttacacagacccattaatctttctaagctattgagaaattttacacgtactgtgactgaggagaacctgatactgtaaaagagcaattcagtacagtttcaccatccaaggacttaccgatgcaaattcaaatacacgtgctaagtaaaatgggagagatagagcaagggagatataaaaattccaatagagcaattccagatgccccatctgccaccacgtgcaatggatctatgttcactagtaagtgtgattgaggtaggagatgtggatctaccactcttcccatctcagttcctttggtgaactgttgagtgtgaacattttgccttacattgggtgattcaaggggttctccacggtaaaagtgactatgtcagattcttgccacataatctaagagatgactccactgaagtttgtgttactctaccatcaaaagatgtatctatgtttacagacattcttttattcaatttgaaaagaaatttcaatgtcaataataaatattagcctcatttgtgaattaaacagatgttaagattgcatgcacgtcagtaaaaaaactgttgtacaggaaactctatgcacaggagcctcctaccatgtcatccagctcagctacctttttctattcagctttctgcaagtatttattttatataatgcacatgtaactataaggatacaaacatggatcatacaaagaacctgccctcatggagcttaaaatctaaagacagatgataagtgctaaacataaataactgtccacaacattaagatatcagtaaattcattcattcatttaattcactcatacattcacttgtgcagcaaacatttactgaataggaactgatttcaaaattttcagctaggaatgcaaaactgagagagaaaaattcttagccttcaaaaaaatcaaagtcgaactgctcagacaaaaattcaaagggaaaaataaattataactacataaggactttaatagtcctctaggagtacattagaccaaacacctaccaccagctgggctattcagggattatcttacaaataaggtcatgaaagaggatgaagtactctcctgaaaggcagtgcctaaaaagagggtggctggcagagaatgaactcacattacatagcactttgcagtttgcaaagtagatagtcatatattgtttcctttgactatcacatcaactgataagaaaactgagacccagcagattcaaaggtcttactgaagaccataaagttagttaaatgtggccaggtgcagtgagtgactcacacccataatcctagcagtctgggaggccaaggtgggcagatcatttgaggccaggagtttgagaccagcctggccaacgtggtaaaacctctactaaaaatccaaaaataaaaattagccaagtgtggtggcatgcacctgtaatcccagctactcttgtgtctgaggcacgagaattggttgaacctgggaggcgaaggctgcagtgagctgagatcgtgccactgcactccaccctgggagacagagtaagactctgtctcaaaaaaacaaaaaaaaaattgttaggtaaatcctggagttgggacccaggcaccagtcatctgttctctaaatattgtcccatgtgttctgttaagtaccatggagaaagcaggagtaaaatattttggcagctctgagaagggagaatttactttcaactgggagtatcagagaatgctttgtagataaaatgacatttggtcttgcagcttgcattcagttatgcagagttgaagatgaagggcatttcaggctgggagaacaatctcacaaaggtgtggatgtaggaaaatacatgaacgtttatagaaaaaaaattgagtgtggtcagaatttattgaacttgagaggcaatcatgtagataggagataaaacaggaaaaggagaatgagactatatttttagggtcatgaaaattaagcaaaggaatattttctaaactaaggtgagctattaaagattttgaagagagggagtcctatgatcatagctttgcttatgaaagaatgaagtggcagcaatgaagacacaccttggaataccagaagactagagtaaggagactaatgaggggacttatagcaatcatttgctttgcaggtaataaggtggtaactaatacaagatgatggattacaatattaaattttgtattcttttaagttctatgtttctgcaatggctaaatgcaaacctatcaggaaaagtaaagcgttttgttgttattgttgttgtttttgcttttcaaaaagtgcaggtaattagggcctaacgtggaatggtccatgctaggaataaagtagatagcggcgaatgtttgctagagacattgtgatggactgatctgccctactattacatcctcagcaataaatatgaatgtttaagtggtacaattgccagaaatcagccaaagtttggcataattgttagagatttgttggctgtggatagaactacataattttggaattgtagaggagaacagagaagaaaccaacaaaaaatagtactagtactctgtcactggaaagaagtatgtttaaggccacacagtgaaagttagccatgagcttgagtgctctatcatttttcattatgttgtttgtttattaaaaaaaaaaaaggtaacagctttttctttttaaccaaacatttcttactggaagttcaataggtgtacagttgttttgtttggctagacatggatatttgtgtgttattccctttcagtagttctgaaaaccattttatctttagatacattattttcccaggagcttgggtattttattgaagctgtttcaaatgcatttaatgtcctttgtaatggatttctttatctcttccccaatgctcttggctggagatgttactttttatttgccttatcggtgtgagcacctcattgctataatcaatagatatagtactttagcattctgtacattttaatatgatatataccaaatataatgtataaatgaaaagttatagataatttttgcttaagttttcttttatagagaattgttaacaaaggatatacagccaatatgttaaaataatacctagaaattaaaaaggagtaaagtagaatagtttatctgttgtactaagacttcatacacaatatttcgaaaagtgggaatatctcttgggtgaaatacttcatatatgtattgtatgtacatacatgcaatatgtacacacagaattatataaaatatatgtatatgtatacatctatatgtacagaacatataattttattagcatttcttgtaatggcattttattataaatccaatgacctcaattattctatgggtaagtgctaagtatgtcaagagagctggcatagaaaatggaaaaagcactacaccccttagcttgcaagtagatgtgaattttctgcctttgactttgttgaatctgtgatgaatcatatgtttactctgattaacataaaacatctggatgatctaactttggggacacattgcttcatatgcactgaatgcctgaaaattggtagaattttagattctttttctttataaatgatactacccgaattcctgcaatacctagagagttacaagtgcttagctctgaccttttattccattcaattgaagttgtccacctttagtttattacacatatgactcttagtagagcaaacatctggattattgtcaacagttctcaaacacaccatttggatttcactatcagactacgaacgaacccccatggaaaaaaattcaggcatacaggctacacccagatcctgaatagcccctggttttctggttactattttctcaggccagatccaagaagtcctctttgggcttgtctctgggattctctgataaaattggctttagattgagactgacgtgaagatagagctggtcattgaaagacagaaacagatgtgaatgaaataattctcctttgagacataaaaaaatgtaagatataccaagaaaggggaatttgagttgttcattttctgacaactgtgaaattgttgacccggacaagagagtagggagattaacaatgtgatcatgttcagggcccactgtgccactgaattaagacaatgttggcattctcctcagtcatcttccgaaaatagagatttagagttaggaaaggaatagcctatcccattaactacgtcactcatctcatgcaggtgacctctcatttatgtatttctcaggatatagaccaacgctggagtatagaaatattatgagacacttcgtaattttaggtcttctggtaccacatttaaaaggtaaaaagaaataggtaaaatttatttcaaggatatattttatttaactcactgtatcagattattttaacttgtaaacaatatatataattattaatgagatatttaacattctttcctcatactttgtctttgaaatcctgtatgtattttttacttacatcacatattaatttggatgcccaattgtcctcaattatactggatctttattggacatttagatctcataagatttacaattagaaatatagattcacttcccaagttgttccaaatatagtattattaaatcaactatcagtcttttaattcataaatattaagtaagactaaaaatttagtcctttagtcatactaaccccctttcaagtgcccaacagcctcttgtggccattggctgccgtattagacagttcatatttagattatctgggtttgaactcagagtctgccactcactgactgtattggcaagttgttgccaacctgggcaagttttttctctttttatgcttcagtttcctcacctgagcacacctttttccttgaagaagctctcctgaagaaaatcccgtatttttcttcaggacattgctatttttccacttaaactcagaaccttagagtgatcactgaatcctcctctccctcatcagctttatctgccagaaggtcaagtcctctgagatgtacactgtaaaatctcatgctttcctgtgacttcatttccactgccactaccctctccttttgcatggatagctgcaatgatctcctatttaattagcctcagtctccagactctagccatcactccacattatgccctctggatgctgctactgagttcattttctgaaaatggtatctttatcatactctccacagttcaaactatttcttcactgcccgtcacttccagcataaatccatgtcctctgtgaaaccttttttgacaacttccatgccagatccaaatgacaactcccttccttgtgctgtcatggccctccacacagacttctgccatagccccagagtcctagtccacatataggagtacatgggctctaagccctacacagactattttgttgttgttatttttgttttgttttgttgtttgttcgatatcttgatatctctgtaacagagcacagtggtttcttgacagtttctcattttctgtatgagctagtgaatgacattcctttgtctggcattccaggccttcagaattagctccacttgactcttctggctccttctcttgcttttcatccacacagatcctctggtatagacaaactggtgtattactgtctcacaaatatgtccccaatgtttgtgtctccatgccttggctcgcatcctctcctcttctgaagtgtccctgcattcttcttgatctgcccaaattctaccctttcttcaaggtccagtccctccctcttccatgatgaagactgcggagcatgatgcaattcactgtgtttcaaattcaggattgggtggcctgatggaaggaggccaggcttggggtccaagtggatctgtttcttctgttttccgccaagttgcctaccctctctgaggttcacattccatatctttgaaatcacagtaacaaaacataaggtgcagaactatcttgagtattaagaataacgtgtgcactggcattcagtgagggttcagatggagcacgtgaactctgttactttcagtacagtcataggatatgtaatcatgtagcttctaaaatgtctttcattgtaagattttgttgtcatttggattgctatacaattcatgcttgatttctaaactagactgcaagtgtctggactgaaacaaatgcataatagaattctgagcagatatgcacagatatatatatgtgtgtgtgtatgtgtatatttgtgtgtgtgcacatgtatttgtagatatcaagggagagaggcactttcatgtgtattgattcattcagtccccacaagaaagcatcattctaggaggaagttgaaaatgtccctattttatctatgaagactctagacttgaagagtttgagtccttcccaaatcagtccaactcttaaagtgatagaagcaaaaaattcacagtgtttacacatcttttccaaagctgtttgatgttattatttcccgcatatcacatctgtgagattatctgcctagatcaatatatgtgctaaccatctgtcaatctttatctacatgcaattgtacccaggttcagggattgtgggagggagaaaggttaggtggttgtaagaaggacactgcatagtatggtaggcaaatacagaatacctgcaacaagacaaccatggcatttcttttttttttttttttttttttttgagatggagtctcactcagtcacccaggctggagtgtagtggcgcgatctcggctcactgcaagctctgcctcccgggttcacgccattctcctgcctcagcttcctgagtagctgggactacaggcccccaccactacgcccggctaatttttttgtatttttagtagagacggggtttcaccgtgttagccaggatggtctcgatctcctgacctcgtgatccgcccaccttggcctcccaaagtgctgggattacaggcgtgagccaccgcgcccagccaaccatggcattttttgttaggtcactcagcattggtatcaagaataacaaatgacacttgagtttctttttcctgaaaaagggcaggaagagtctaatagcaagtgcaattgccacaggcaacagtgttataactggaaaatcctaaaatgtagataattttcctccaaatgctttctaacaaaagatagacaagtttaaatttggctgatttcatatctaccataatatagtaccagcaatgccaagatacagaaaactgcctaagaaaaacagagttcagaagacttcggataaattatcatcttaagcttaaccttatacctataaaaaattcagggatatcagttatgacttctcattgagtagtctcatgttagaccaaaatagtttcccatattttggtgaaggaccagaataacttaccagtaaatgaaacaatcattttctttttgctttatactcattctgcatgtgatttgtataggggatcaagtcaaagattgccagtacaaagtaacaacctctcattgtattgcttaagttaatcattaatattttccatggatcaataccctgtagaagcatgagatgcagcagtgatcttcaatttcatgtgcttgccaagtaagaacagccatgggccagattgttgggagccgtgccatgagctacagaccctcagctcccctctataatcagttcttcccccactccagtgctcccaacttgccctaagcagagcgtaattgtggatgtgtaactaccgcagaggggagtatgctttttatgttgttcaattcttcactttctcttctgcaattgaaagttgagctgttagatttcctgaaatgaaatggtgacaagagaaagtaacagaagtagcctttataagtgcctgacttctgggtaacagaagtgacttaaaaaaaataaaagtacaaaacgttgcatttaatgtaaaagatgactgcattagtacaacccttgaaaacattcaagttcttttcagaataaccaccattaaggagttgacaaatattttatgctttaaagtatcctataaaagttcatcacagaaataaaaagcctcctgttcttatccttctcaacaaagccctcttgtatatagatattgagtctggcttacctctgtatcctgttgtgctgataaaccaagaaccttgcaaaaatagatgcacgataattgatatttaataagtgagcgaatccattaatgaaaagagtgctatttcagagagcagtgttcatttagatagatggtcccagcgtcattaagtaaaaggatagagaatacttgcaatacatttggcgtagtgttaagaattttttaaaatgttttaaatgtgatcttttttatgggctgaattgtgtcctctcaaaatgttgaagtcctaacccctggtacctcagaatgtaaccatggagataaggtctttaaagaggtgattaaattaaaatgaggtctttagagtggcccctaatccaatctgaatgatacctttataaagggagggaatttggactcacaaagagacattagacacatgcacacagagacaaccatgtaaacacatggtaagaaggcagccatctgaaagccaaggagacaggtctcagagaaactaaacctgttgacgcctttgatcttggacttccaaactgtagaacactgacaaaacgtattactgtcgtgtaagccacccaatctgtggtattttgttatggaagccctggaaaattaatacagtcttttttatttgctacctttgaaagccctcttgtcaaatgacggtaaagaatagaagacaataaagtgtcagtaataaagggtgacgagaagaaacaactagagatgtgagaggaccaatttaggaaatggaaaggagaggaaaaaatcaacaaagttgagaatgctaattacaaagtgcccacagaggagggcaaaaccagcaaaccattccctttgtcaaaatcttgaaagatggcaattgaggaaccaagaatcttaaaaaggggggaaggtggatgagaaatctgcatatgaaggggagtcctccataggttctcctctcaccctgctcagctaggagaccagtgccactttatcctcattagaatggaaatttatgctataaaaataaataagagaagtcttaacctggggatactaggcacattggaaggtgagagagtaaatgaaagtctatcaactgaatagtgaagttctgacttctctagtagcacctgggaataagaactctgtcagttagccttataatgccaagagaggagatagaaaaattgtttttctataaaaattgtctaaaaaaatatctgcactcccatgtttattgtagcactattcacaatagctaagatttggaagcaacctaagtgtcccatcgacagacaaatggatgcaaaaaaacatgcagtacctataaacaatggagtactattcagccataaaaaaagaatgagattgtgtaatttgcaacagcatagttggaactggaagacattatgttaaataagccaggtacagaaagataaactgcatatgtcctcactaatttttggtaactaaaataaaaatacttgaacttgccaggttcaggggctcacgcctgcaatcctagcactttgggaggctgaggcaggcagattgcttgaggccaggagttcaagaccagtatggccaacataatgaaaccccatctctactaaaaatataaaaattagccagtcatggtggtgcatgcctgtaatctcagctacatgggaagctgaggcacaagaatcacttgaacctgggaggcagaggttgtgatgagatcgtgccactgcactccagcctgggtgatggagtgagactgtctcaagaaaaaaacaaaacaaacaaacaaacaaaacacttgaactcgtggagatagagagtaggatgccatttatcaaagagtgggaagggtagtggggaggaagaataagatctagtatttgatagcataagagggtgactacagtcaacaataatttattgcatatttaaaagcaactaaaagaatataattggaatgtttgtaacacaaagaaatgataaatgcttgagatgatggctcctccatttatcctgatgtgattattacacactgtatgcctgtattaaaatatttcatgtgacccataaattcatatacttactatgtactcataagaattaaaattaaaaataaaaataaccaagaagaattcttcttcagaaaaatggaattaccacccagagaaaagacctatagtactggcattagatggttgcccaataaagaagccaagggtctttattcctcaattaccccatgtattaggccattattgcgttgctataaagaaatacctgagagactgggtactttataaggaaaacatgtttaattggttcacagttctgcaggatgtacaagcatggtgctggcatctgctcagcttctggggaggcctcagggaacttgtagttgtttcagaagacaaaaggggagtaggtgtctcaaatggtgagagcaggagtaagggggttgtgggagttagcacacacttttaaacaactagatctcagagagctcattcactcactcaccaagccataagggatctgcccacatgacccagacaccacgcaccagggcccatctccaacactggggattacatcccaatatgagatttggaggggacacccaaactgtatcattccgcccttggccccctaaatctcatgtccttcttacatggcaaaatggaatcatctcttctcaacagtctcccagagtcataactcattccagcattaactcaaaagtcccaagtccaaatacaaaatcttgtctggaaatgagttcctcccacttatgagcctgtaaaattaaaacaagttatttacttccaagccaaggtacaatagaggtacaggcattgggtaaacattcccattctttttttttttttttgaaatggagtctcgcttagtcacccaggctggagtgcaatggtgcaatcttggctcactgcaacctctgcctcctgggttcaagcgattctcctgtctcagcctcctgagtagctgggattacaggcacccgctgtcatgcccagctaatttttgtatttttgtagagatggggattttcatcacattggccaggcttgtcttgaactcctgacctcaggtgattcacctgtctcagccgcccaaagtgctgggattacaggcatgagccatcatgcctggccaacatttccattctaaaaggaagaaatcagccaaaagaaatgacttcaggccccacccaagtctgaaacacaacaggacagtcattaaatcttaaagttctaaaataatctcctttgactccatgtcccacatccaggtcacactgatgtaagggtagactccaaggccttgggcagctctgcctctacagcttttgcaaggtgaagcctccatgactgctctcatgggttggagttgagtgcctacggctttcccaggtataggatgcaagctgccagtggatctacattctgggacccacagaacaatggcttccttcccacagttccactaggcaatgccccaggggggattctttgtgggcagggcttcaatcccatattcccttctgcactaccttagtagaggttttctgtgaggactctgtccctgtagcatgcttctgcctggacacccaggctttctgatacatcctctgaaatctaggcagagactaggatcactctttccattctttctatctgaaggcttaataccacaaggaagccacaaaggcttacagcttacatgctccagagtggcaacctgagccatacctgaggctctttgagccacggctggactggatggaccatgatgcaaggagcagcctcctgaggtagacagtgtagtggtgccctgtgcttatcccctaaaccatttagtcctcctgtaccactgggactgtggtgggaggagctgcctagaagatctctgaaatgctgtaaaggcctttttcccattattttggctattagcacttgttctcttttagttatgcaaatttccctagcaaatgattgcttgcagcctgcttgaattcctccccaaaaatggccttttattttctatcacatagctaggttgcaaattttccacacttgtaagctctgcttcccttttaagtaaaaattccaagtttaggttatttctttgcttctgcatctgagcataggttattagaagcagccaggtcacatctcaattgcttcagtgcttagaaatgtcttctgccagataccctaagtcattaactcttaagttcaaactttcacaggtccctgggcatgaatataatgtagccaagttctttgctaaggtataacatgggtgacctttgctccagttctcaataagttcctcacttacacctaatactttgtcagcacggactttactttgcagatcactatcagcattttggtcatgaccatttaatcagtctctaccaagtttcaaacttttcctcatctccctgccttctcctgagccctcccaattcttccaacctctgtctcttacccagttccaatgtcattttgacattttcaggtatctttatagcaatgccccactccttggtaccagtcttctatattaggctgttgtggcattgcaataaagaaatatctgagactgggtaatttatgaagaaatagaaaattaactggcttgcagttctgcaggctgtacaagcataatgccagcatttgctaagcttctggagaggcctcagggagctttcaatcatggtggaagctgaagagagagcagctatctcacgtggcaatagggggagcaagagagagagcgggaaggaaggtgttacacacctttaaacaaagagattttatgagaacttgctcacaaagctataagggaaccactcccatgactcagacacctcccaccaggccccacctccaacactgaggattacatctcaacatgagaattggaggggacattcaaggaacaccaccctataatgaaccccaagactctacaagtccagttaaatcattcaaggctcccagtcagtattttagtgtctccctgttgaatatgaatagatagccaagtctccacaaaactctgaggaaattcttcaacaaaaagcctaatgcaaacaaatgaaaataatgatgatgattaggttgatataaaaagagtttaagaaacaaatagacgtttcagaaaaaataaacttcgtagccctagacagatgacaagttatcacattaatgaaacaaaaggatactatacaaaattatcaagtaagaacaaaagagagttagaatttaaaacaatgaaagaagatgctaataaataaaatcagagatgaaaagggagatgttgctgggcacaatggctcacacctgtaatcccagcactttgggaggccaaggcaggcagatcatgaggtcaggagtttgagaccagcctgaccaatacggtgaaatcccatctctactaaaaatacaagaattagccagcgtggtggcacgtgcctgtaatcccagctactcagaaggctgaggcaggagaattgcttgaacctgggaggcggaggttgcagtgagccaagattgtgccactgcactccagcctggatgacagagcaagactctatggggggggggggggggaaggaaagataaggaaagataagggagacgttacaagcaataccacagaaattcaaaggatcattagatgctactaggagcaactatatgcaaataaattggaaaacctaaaaaaatgataaattcctagacaaatacaacctaccaagatttaaccatgacgaaatccaaaacctgaacagaccaataccatcaagattgaagccataatgaaaagtctcccagtaaagaaaagcccaggatctgatggctttactgcttaattttgccaaacatttaaagaagtaatatcaatcctactcaaactattctgaaaaatagaggaggagggagtacttccacacttattgcacaaggccagtattaccctcataccgaaacagaccaaaggcacattgcaaacagaaaactacaggccaatactcccaatgaacatttatgcagaaatcctcaacaaaatactagcaagccaaattcagcaacacattaaaaagattagtcatcgtgaccaagtgggatttttcccaaggaagcaaggatggttcaacataatgtaaatcagtcagtgtgatacatcatatcaatgaaggacaaaaacatatgatcatttcaatttatgctgggaaagcatttgataaaattcaacatcccttcatgataaaaactcaaaaaactgaggatagaaggaacatacctgaacacaaggaaagccatatatgacagacccacagctagtatcatatcgaatggggaaaaattgaaagtttttcctccaagatctgtaacatgacagggatgtccattaccccttgagcaatcagacaggagaatgaaaggatattcaaattggaaaggaagaagtcaagttattcttgtttgcagatgatattattttatatttggaaaaacctaaagacttcaccaaaacactactagaactggtaaacagattcaataaagttgcaagacacaaattcaacatataaaaatcagtagcatttctatatgccaatggtgaacaatctgaaaaagaaatcaagaatgtaatcccatttataatagctacaaataaaatacctaggaattaacttactgaaagaagtgaaagagttctacaatgaaaactataaaacacggatgaaagaaattaaagagaacacaaaaaatggaaagatatttcatgttcatggattggaagaatcaatattgttaaaatgtacatagtacccaaagcaatcttcagattcaatgcaatctctatcaaaataccaatgacattcttcacagatatagaaaaatatcttaaaattcatgtataaccacaaaagacccagaatactcaaagctatactgagcaaaaagaacaaaactggaggaatcatattacctgacttcaaataacactacagagctatagtaaccaaaacaggatggttctggcatgaaaacccaggaacaaattcatacatgtacagtgaactcatttttgacaaaggtgccaagaacatacattgagaaaggacagtctcttcaataaatggttctgggaaaactggatatctatatgcagaagaatgaaactagacttctatctcttgccgtatacaaaaatcaaatcaaaatggaataaagacttaaatctaagacttcaaactataaaactattgaaagaaaacattggggaaactctccaggacattggcctgagcaaagatttttttttttttttttagacagagtctcactctgttgcccagactggaggctgaagtgcagtggtgtgatctcagctcacagcagcctctgcctcctgggttcaagtgattcttgtgcctcagcctcctgagtagctgggactataggtgcacaccaccatgctgggctaatttttgtatttttagttgagacagggttttgccatgttggccaggttggtctccaactcctgacctcaagtgatatacctgcctaggcctcccaaagtgcatggattgcaggtgtgagccactgcgcctggcctgagcaaagattttttgagtaataccccacaagcacaagcaaccaaagcgaaaatagacaaatgggatcacatcaagttaaaaatacctgcgtagcaaaggaaacagtcaacaaggtgaggagacaacccacagaatgggagaaaatattagcaaactatccatctgacaagggattaatatccagaatatattaggagctcaactccgtaggaaaaaaaatctgataatccaattaaaaatgggcaaaacacctgaatagacatttctgaaaagaagacatacaaatggcaaacagtcatatgaaaaggtgtgcaatgtcattggtcatcagggaaatgcaaatcaaaactgcagttaaatattatctcaccccagttaaaatggcttttatccaaaagacaggcagtaacaaatgctgacaaggatgtagagaaaagagaacactcctacacttttggtgggaatgtaaattagtacaaccactacggagaacaatttggaggttcctcgaaaaagctaaaaatagaactcccatatgatccagcaatcccacttctaggtaggtatacacccaaaagaaaggaaatcaatatatctgcacttccatatttattgtagcactattcacagtagccaagatttggaagcaacctaagtttccctcaatagacgaatgaataaagaaaatgtggtacatatacacaatggagtactgttcggccatagaaagaaatgagatcctgtcatttgcaacaacatggatgtaactggaggatgttatgttaaatgaaattatccaggcacagaaagatcatcttcacgtattctcactatttaagggagctggaaattaaaagaattgagatcctggagatagagattagagtgatggttaccagaggctaggaggtgtagtggatgggaggaagtaagaagtggggatgtttaatgggtacaaaaatataattagatagaacaaataagatctggtatttgatagctcaacagggtgactacagtcaacagtagtttatcatacatctcaaaataactaagagaatataattgaattgtttgtaacttaaagggtaaatgtttgcagtaatagattccctgtttaccctgatattattatgcattgcttgcctgtatgaaaatatctcgtgggccccataaatcaatcaatctatctatctatctgtctgtctgtctgtctgtctgtctgtctgtctacctacctacctattatgtaccaacagaaatttaaaatttaaaaaattatgttttggagacgtctagaaaaattggtgataatgtcacataatcaaataaagaaggtaatatataactccagaaaaaacaaaaagttgttccataaataaaacataattatggcacatcatttggtttatcagtaaacgttactttgcagggatgatacaatagaacactgaatgtttatttagccaataattgttatataactgtaatgggaggatagaaagagggaagtagagaggtgaaatggtgaaagagtgtgaaatcttcatcattcataatagaaagtcagttagaaatatggaatttaaaaaaaaatagtttgagagccttatgaagagggtggcacaaaagactcctgcaacttgttctaagccctgtgcatacaatttggggtgtgtgggttagtttaataattattttgtaaatataaaaggaaccaaagcaaccaaatttctggatataaatgtcctgtgttgattatcatgataataggtagacatcttggattggaattttttaacatttgaatggaataccccatttcccctttaatctttgataggtttaacatggtcactaactgtagagtagggacttgtcgtgctctttattggcagaagtgtgactggctacccctgaccgttcgggagaggagacatgtacacctggccaatcagaccagcagattcactgctggtgatgagtgaagttgcagatgtcagggacagcttgtgctgttcaggttaaattatctcacttcagctctcactctaaagatgatttataactagtattcttcactttcagtcttttcactagcaagcaggatacttatggaaaataattaggatgaaaagaggtcactctatcacaatagtgagtttttgaattcacactttaaacgagatgatcctccttaggaaaagcaaaataaaacgaatttccatgccattgttgattctacttgagttaaatactaacataaaaagttggttttctgtgcatagcctggagaatcttgtctctcagaattatcatgccccaggccattccttgcagattttgaattccctttgtctcaaaaacatccagaaaatctttttgaccttcgggtggttggcagaacatgtgttgtgagggcacctcagtttagaagaaaagccctgaacttagttcaaaagaagggctttccagcatgctattcattcagcttaggactgccaggcttcctgaaagacaggtgtgtcagaaacaaagtaaataaacagaaactcacaatgtccagacctttctctccagagcagcacagttcccttgctgagcggcaacagccaaggctttaagctgttccctctcccttttctgttaattgagaaaaccaattgctgcaagagcaacatcagcagagctaaatgtaaatggagtttaatagaaagagacaaataacccactgagaacccctaacatttcagtgtaataccccagagttccacaccataaacttggtattccagtataaagctcatctctcaattgcacgccaccctcccccatcttattcactctcttgcattattaaaggagtgatctcccccatgggatcaaaatagatagatagatagatagatagatagatagatagatagatagtctctaatatatgtattagaaacagagtctgtgttgcccaggctggagtgcagtggcatgaccataggtcactgtaaccttgaacgtttgggctccagcgatctacaggtgtgcaggtctacaggtgtgcaccaccatgtccagctaatttttaaaatttttgtagagacaggatatctctatgttgcccaggctggtcttgaactcctcttctcaaatgattctcctgccttggccacccaaagggctgagaatacaggtgtgagctaccatgcccagccataaacatgaaatttacttatgttttatgtataccatgtgcacatagcctgaaggtaattttacacaatattttaaataattttgtgcatgaaacaaagtttgtgtacactgaaccatcagcaaaggagtcactatctcatgtcagtgaccaaaaagttttagactttggagcattttggatttcagagcatcttgaattttaggtttttggatggggatgctcaacctgtatatatgcatacatgcatatttatgtaacatacataatggtacctaaaacttagcaaatactcatatgttagctattatttttgttggtattactatgaataataactattagcattttctctcatatctaaaatgcagttggtaaatgctaaactcataggaatgttgtaaagatttatttttttattttttttattattatactttaagttttagggtacatgtgcacattgtgcaggttagttacatacgtatacatgtgccatgctggtgtgctgcacccactaactcgtcatctagcattaagtatatctcccaatgctatccctcccccctccccccaccccacagcagtccccagagtgtgatgttccccttcctgtgtccatgtgatctcattgttcaattcccacctatgagtgagaatatgcggtgtttggttttttgttcttgcaatagtttactgagaatgatgatttccaatttcatccatgtccctacaaaggacatgaactcatcattttttatggccgcatagtattccatggtgcatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgattgccattctacctggtgtgagatggtatctcattgtggttttgatttgcgtttctctgatggccagtgatggtgagcattttttcatgtgttttttggctgcataaatgtcttcttttgagaagtgtctgttcatgtccttcgcccactttttgatggggttatttgtttttttcttgtaaatttgtttgagttcattgtagattctggatattagccatttgtcagatgagtaggttgcgaaaattttctcccattttctaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctaggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatatggccattttcacgatattgattcttcctacccatgagcatggaatgttcttccatttgtttgtatcctcttttatttcattgagcagtggtttgcagttctccttgaagaagtccttcatgtcgcttgtaagttggattcctaggtgttttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttaaataggagtggtgagagagagcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgtagggttgttgaattttgtcaaaggccttttctgcatctattgagataatcatgtggtttttgtctttggctctgtttatatgctggattacatttactgatttgtgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtattagaatgatgctggcctcataaaatgagttagggaggattccctctttttctattgattggaatagtttcagaaggaatggtaccagttcctccttgtacctctggtagaatttggctgtgaatccatctggtcctggactctttttgttggtaagctattgattattgccacaatttcagatcctgttattggtctattcagagattcaacttcttcctggtttagtcttgggagggtgtatgtgtcaaggaatttatccatttcttctagattttctagtttatttgcatagaggtgtttgtagtattctctgatggtagtttgtatttctgtgggatcgttggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttaccttctgctagcttttgaatgtgtttgctcttgcttttctagttcttttacttgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcggtttccatgtagttgagcggttttgagtgagattcttaatcctgagttctaatttgattgcactgtggtctgagagatagtttgttataatttctgttcttttacatttgctgaggaaagctttacttccaagtaaatggtcaattttggaataggtgtggtgtggtgctgaaaaaaatgtatattctgttgatttggagtggagagttctgtagatgtctattaggtctgcttggtgcagagctgagttcaattcctgggtatccttgttgactttctgtctcgttgatctgtctaatgttgacagtggggtgttaaagtctcccattattaatgtgtggaagtctaagtctctttgtaggtcactcaggacttgctttatgaatctgggtgctcctgcaggtgcatatatatttaggatagttagctcttcttgttgaattgatccctttaccattatgtaatggccttctttgtctcttttgatctttgttggtttaaagtctgttttatcagagaccaggattgcaacccctgcctttttttgttttccatttgcttggtagatcttcctccatccttttattttgagcctatgtgtgtctctgcatgtgagatgggtttcctgaatacagcacactgatgggtgttgactctttatccaatttgccagtctgtgtcttttaattggagcatttagtccatttacatttaaagttaatagtgttatgtgtgaatttgatcctgtcattttgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaaggattttatttctccttcacttatgaagcttagtttggctggatatgaaattctgggttgagaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctgtgtatttcctgaatctgaacgttggcctgccttgctagattggggaaattctcctggataatatcctgcagagtgttttccaacttggttccattctccccatcactttcaggtacaccagtcagacgtagacttggtctattcacatagtcccatatttcttggaggctttgctcgtttctttttattcttttttctctaaactttccttctcacttcatttcattcatttcatcttccattgctgataccctttcttccagttgatcgcatcagctcctgaggcttctgcattcttcaggtagttcttgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaagtcattctccatccagctttgttctgttgctggtgaggagctgcgttcctttagaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagcctgcccctgctggagcctcccagttaggctgctcgggggtcaggggtcagagacccacttgaggaggcagtctgccagttctcagatctccagctgcgtgctgggagaaccactgctctcttgaaagctgtcagacagggacatttaagtctgcagaggttactgctgtctttttgtttgtctgtgccctgccctgcccccagagttggagcctacagaagcacgcaggcctccttgagctgtggtgggctccacccagttggagcttcccggctgctttgtttacctaagcaagcctggacaatggtgggcgcccctcccccagcctcgccgctgccttgcagtttgatctcagactgctgtgctagcaatcagcgagactccgtggggtaggaccctcccagccaggtgcgggatataatctcgtggtgtgctgttttttaagcccgtcggaaaagcgcagtattcgggtgggagtgacccgattctccaggtgccatccgtcacccctttctttgattaggaaagggaactccctgaccccttgcacttcccgagtgaggcaatgcctcgccctgcttcggcttgtgcacggtgcgcgcacccactgacctgcgcctactgtctggcactccctagtgagatgaacccagtacctcagatggaaatgcagaaatcacctgtcttctgcgtcgctcaggctgggagctgtagaccggagctgttcctattcggccatcttggctcctcctgttgtaaagattcataaagttgatagattttaaatccttggaactgtgccttgtatatggtgaagaatagaaaagtgccatctttcattattttcaccaatagtaataaagcacaattgtatagtaaacttgtaatatagtatatgctcaataaattgttaattaacttttgtgttcatttcctagtgcatatatatcactaagggaattgatactaatgtcattgcatgcattaatggtaacattaattatcttcttacacattgggcaaaaaaagaaaataccaggctgtcagaacatcttggcccagaaacctcccttcagcaaaaagacaaaaatgtgagtgaagagaatatgcctttgagaattgagagggttgcattttgcctattatgtatagagatttgccaatttccctttcacaaactatgacagtgacactgattctggatgagcaacctgcataatgcttcaggggcacatctcttcttctaaggctgcaggcttgccgatgagacagaacacagcctcaattccatctgctgtcatttatctgccaatatagatagcagatctctgtgggtcttggactgctcaaacgacacagtatattttagcaactgaaggggaaccacttgagatcactaaaggtggaaaacacctgatgacaccttcaatcgaaagaaatgagtatccaaaatctgaaacattaggccccacagtacaatggctctagtgacagataaaaaatactatttctaacccttatagaatgaacttgttttcaagagctcaaagaaaacttttatcacatttatcttccacttttaattaaaaagattatttctgaaatgctaaaacttttgttttattcatgttttagaggaaaggagaggaagagaaaccacctgttactttcttgatgctgtacctggcacctgcccttgattgaagatgagttttgcatggtgtctgaaccaaaaataacaagtcctttaaaaattattgtcctaaaaaccagcagatcaaactactttcttttttctcagaggattcacaaagtatattgtttggaaaggcaaagtcagtgaagaaaaaagaggaacgtccctaaatattggtgttgtcatttataatgtaagacttcactagaatgagattatctcaggtgtgaatggagaaaggtaggatgcatgcagtgtggaagcagccagattcaacacactaaaatcattaacacatatgtttgtgtagttgtgtgtaattttgagggggagaagaggaattttgcctttaattctcactccaaccacttgaccaataattgggaatcatctcttttatcccctatttttgccccttgttctatatgttatttttttgagatgttctttatcataaagtgcctttacgtaggcagtatataagcagtatgcaaaattgagtccccatctctggcattgatctcaaagtcctttttttgttgtcaaatacctttgaatctgtgtcttcaaactctgcttgggttcactcaaatcagtatatttctttccatatgtaggtcttttgatttttgtcctaggttgactctttcctgagttcccttttacatcagaaattaacattttcctaattatccagtctagaaattttagtcatcattactttttcttttcattcatttttaatatccaatccatcctcaggttcaattaatcctttcttcaaactctacttcccctgtctttcattcttcagctgagttcacatcacataggtcctcatccattcatgccaggacttcgacagcagatactaacaggcatcaacctccagactcgttaaattaatcctacacactatttccaggtgacttactgaaagtcttcatttgatcctgtcactctccctttcaggactcttccagcaggtcacaactcacatatctgcaggagccaggagctattcaaatggagaaggcagggggatcctgggcaaggagggtatagatatatcctcacctgcatgcgcagtgacttctgagctcctcacagttgttatcatgtgaaaatataggccagggttggcaggctttctgatttttcaagagaacacagaaattagacttttaaaaagttgattcaataaatatgacaaggtatattagggttctctggaagaacagaattaatggaatatatatatatatatatatagacacacacacatatatataaagggtagtttattaagtattaactcacgtaatcacaacgttccacaataggccatctgtaggctgagaagcaaggagagccagtccaagttccaaaactgaagaacttggagtccaatatttcagagaaggaagcatccagcatgggagaaagatgtaggctgggaggctaggccagtctttcttttcacatgtttctgcctgcttatattctagcagcgctggcagctaattagattgtgcccacccagattaagagtgggtctgcacactgactcaaatgttaatcttctttggcaacaccctcacagacacacccaggatcaatactttgtatccttccatccactcaagttcacactcaggattatcacagaaggcatactatgttctgagctttcttctctgtactgtaaaaaaaaatacagcagtgaatgaaacagacaaaaattctacccttgtggagtttatattccagctgggagtgaaagatgaaaataatttatatattatatatatatgtaatatatagaaatatatatttatttatatatctatatttaaaaatatgtatggggaagattttgtgataaataccatgaagaaaagtgtattagagaagaggttaacgaatgtgtgtgtggtgggtggtggaattttaagtggtgttaggaaagacctcattcagaaggtagcatgtgagcaaacatgaaggaggtacaaaaagtcctcctgccatcatggagggacagtaagaaggtcctggtggctggagtgaagtagcaaagtggagaataagggaaaaagttggagatgaaacagaaggggactcagagctctattcatcttactagtggctttgccttattaaacaaagacctttaaacagatgttaacaagatccctctgactcctaatttggagatgactttaggggaataagggaagaaagagagatcagtgagaagcagaattctttttttcagggtctttctcattgttgttctcactaccatcatcctttggacagacaggtactctttttaagtcaatttgatctaaatgtgggttttaaaaaaatccttttctttgtttaacagctgagacaaagcaggaattttaaagcaacactttactgacaaactatgtagaatcaaagtaacatgaaactagataatttgttctatcataggagatatcttattcaaatgaagtcccctaggagaaactcttcttctgactccctcttcacactggacagcagaggccatctttaactttcccacaagagagggctccacaagacatagtcattactcaagagattgagaatcaagacagagaagtttagtctcctcctatgcttacttaaggctcacctccttaactctgatttcctctctgggaaatctctattcctctggtgactgtatactgggatttagtacaacatttagggaagtgcaacctactcaaaatatccaaatatagcaccataattctaacactctaataagaggcacatccacgtattttcaagggtggggaaagatcattaaataacagtatgagttatattatgttctcagtaaatattagttaccttttcttcctcttggagtgacttttaccaccctctgtaactcatctagccttatctaatgggaggccattttattttgggatggcatgactacataatttcaagctatttcttatgttatttgccgcctcttaaatatcttccccttacctccttctcatacaaaccttaaagttcttcataagtcacaacaacttataaggtcttttacctaactgaaccgatgtcttctctttgctgtacatttacatgtctataacaatcatttttcatttaaatatgaaactcttggatataaaaatattaacttgaaaaatagtaaccctgatttgctctttatactttaacaccttttgtttctttgtttataaatccactgtgcaaagctgtttatgcagcagaaatttagtaaacattctgtgaatgtctgaaacatccattcatcaatccactcacacaaaaacattaacatatactttgtcatgcattgttagatgttcaagcatgaaaatcaaacagtagtgaagaataatttattgtaaatattatttttcagggaagagaacactttagaaataacttcttgagaaattggtttgggaaaatagtatatccaaaattagagagcgccatcttgtgggcaagtgagtatctcacacaaataataactattataagttgcaaaaatagaatttcttctctttttttcttacaattcaaatctcctttttactgtaaatatttgtattgatgcataataattatacatatttaggaggtacatgtgatattttgattcatgcatacaatgtgtgatgatcaaatcagggtatttaagataaccatcacctcaaacgattattattttttgtgttgggaacacttcagctcttccagatattttgaaatatacaataaattattgttagctatagtcacctttctgtgttatcgaacactagaacttatttcttctatctaactatatgcttgtacccattaactaacctcttttcatcccacctctctcttcccagcctctggtaaccatcattctactctctacctccaagagatccactgttttagctcccacatatgagtgacaacatgccatatctgtctttctgtgcctggctcatttcacttattgtaatgacctccagttccatcaaggacacttaggttgattccatatcttggctattgtgaatagtgctgcaataaacatgggggtgcaggtgtacttttaatatactgatttcctttcctttgaataaattcctagtggtgggattgctggatcatatgatagttttatttttagttttttgagaaacttccatactgttttctattatggctgtactaatatacattcccatcgtcagtgtataggagttctcttttcccagcacccttcccagcatcaaataaaatcttttaaagaggctctgtctgtcctagctgaagaactgaaaatatatattaaaattttatataattaatgatattttaaacaatccttagaaactaattgtaatatttacaatttacttttaaatttcttgaatagctaaaaatgaaggctcagcaaagaaattactaaatatcataaacatgacatacttttcataagaaagcttataaaactgttaatgaaaaaggagacagaattcttagagattatctctttaaggggtctatcactttttgggtatctcagggtgctttgaaaatttgactagatcaaatctctcttgaaaaatgtaaatgtacacacaatttttcatatagtttcaggggcttcaccaactcccctgcggttgactcatgaacccattcatgaacttcatattttaaatacttacattttacataatatacaattaaagtctagaaggtttgggggtaaaagctaaaatttgattccattatctcttcatccccaaaacctcatgctcacacaattttataagattgatatagatagatcaaatcatgatgaaatatatttgctacatcgtttgagttcctaagctaaatcttaaaacttatagtttctaggctattaatgttccttacatcaacaaaaataaatatttaatattaggttcatgtcattcatggtatatctgtcacaaatacccttgatgtccattctatccaaaataaaagatgttattatggatttccttctttttcagggctgggtagaattctagtgtgtgagtgtgtgtgtgtgtgtgtgtgtaccacattttctttatccattcattgttgatgaacacttaggttgattctgtatctttgctattgtaaataatgctataatgaacatgggagtgcaaatatctttttgacacactgatttcacttcctttggatatatacctagtagtgaaactgctggataatatggtagtactatttttagcttttaaagaacctcgatgctgttttccataatggctatgtgaatatacattcccaccaacagtgtaaacatcttcccttttctccacatccttgccatctttcatcttttttgtactaacaggtatgagttgatatctcattgtggttttagtttgcatttccttgattattaagtgatgttgaacatttttttcatatacctgttggccattggtatggcttcttttgagaaacatctgtttagatccttttcttgttttttaatcaagttatttgttttcatactattgacctttttgagttccttatatattttggaaatcctgtcatttgggatcacatggatgaatctggatgacgttatgttaagtgaaataagtcaggcacagaatgacaaccaccacatgatctcatttaaatgtgaaagctaaaaatgtcaaactcatagaaacagaataaaatggttgttaaccagggctgatgggtgggggctgaagactggggcaatgttagtcaaaggacacaaaatttcagttaaacaggaggaataagttccagagatctattgtacctcagggtgactatagttaacaacaatacattgcatacttgaaaatagctaaaagagtagatttttagtgatcttgccacaaaaaaagataagtttgtgaggtaatgtatatattaattagcttgatttagccacttcacaatgtatacatctatgtaaataaaatgttttacatcataaatatatacattcttatttgtcaatttttaaatatatatataccttttagaattacagcttagccttgggttaatgaagtcatgacagtacgaggtttataaaactgaacaaagaatcctaaccatacgccaccctaactatggaaatacaatggaactattagttttctgtttcctctttctttctcattgagaaatcatgtcccttcataaaatccatttctctgtgtcagatcattggagctctttttttctccattattatttataatagttagtcttattcatctcttgctagtatgaaccttagtaacctaggttagtatttcccaaagtaggttttgtggaatgctaatatcaacaggtactacctgcaaaatggttgcatggtcaaataagctgagcttcataaaattaaactgatatattactggaagctaaataaatattgtaaatatccaggaaggagatacataggcaaaatattccaaactttattaaatagttaactttttgtttgcttacagagtaatggggttgggtgctccacagagaacattatggcacatgctgaactagagataaaaaagatagatttaaaaatatatgcagattgcttggacaaatttcagcaggatagtgagaaattgatttctagtgtagaatattctgggaaatgagatttttttacattacgtgatcctaattcaaatattatgattaattttaagtaagcaggcaatttgatgtaatggagaaagcactcacctgaaacagagttaacatgttttattccttggtacagtcatgctggtttttaagtgtttagcaattcattttacctctccagctaaggtaaaggaattcttgtaggagtaatagaagccctgtgattagtataaaacttagattaagatgctttgtgcagcaattcccatggcatatttctttttgtcttttctctttctctttctttccctccctccctccctccctcccttcctcctgcgctgccctgcccttcttttctttttctttctttctttcttgacaaggtcctgctttgtgccccaggctggagtacctgggctcaagctatcctcccacctcagcctcccagaaatcctgggattgcagacatgagccaccatgcccaggcccaagtcatattctaaaacatggcttactctgatattaactgccgtctacaggggaatggtctaattactctgcaaatgctctccaccttctagaatagtcacattccaattagtatatttaaagctcttagaagtcacgtaataaaaagaaatattttctttaagattttgaagccatatttacaaattatttgactctctagtctttttcttgtttttattattcaactggactcttaacatctcaaaaactagtattcaatgtaacagtttggaaaatgttcttataccttttctacttttaatagataaaattgtttttaattcatgccaacagagatgaaccaacaatctaaaagaatggactcctaatcaattgtagtgaatggaccatatgttcatattatctgtaattaaatggaggaatttaaaaggaaaggtgtgagaatggaagagaaggctgcctccccacatcctatccaaggctcctgtttctacccgcacaccctaccacagaaatacccaagatttattttctagagaaatgttctcagaaagggtcaggactctgagagagaagatgtagcaccctgcagggatgaggtgtggggctgaaacaaggaatgaagggaatgtctgtggtgcagatctggttccctgagatactccgagatagatagagattgggatgcagggtgtttgtggggaaatgttctcagtgtgagcaccacaggaagaagagtaggaacagggttaaaggctcaatggaggcctcttctggttcagttggggtttctaaaacttagaggaaggggttaggactctatactatctccttcccgtttatcaaatagccattgtctgcagactgctctgtataaatgggtataatcttgggcaagagcagtataccctctactggagaaacacatgctgaggggattctgggcagtgcatttcaacatccagaagagtcagcatcatgaatgctgaaaccttgcctcctaccccaccctctacctaaaatgaaagtaatcagattaatgataaattacttaaaaaaatagatgctggagtacaatagagtaatggcttcaatattttgaaggaatttacatttcaacatagactcctttagcaagtcaaactatgaactagtgtaaagacagaataaagccatctttagtgatgcaagatccaaaaaatgtaaaatattaatactattcacttcatttgccacttgagcttctataaaatgtgacccacaaaaagcaggaagctatcaaaaaggaaatcatgagatccaataatcaacacgggaaataacagaaagaatgcttaggatgtcagatttctagcgggcctagaaagcaactagctgagaagtacagattgaagcaagagtacaaggtgttgaggaggaggctgaaaagagaaaatgaaattgatagattatccaatttgctagagcatctgagaggggtggcagatatgagtaccatttggaaaagaaccaaagcaattattaactactagcaaaacagaagttgagccgtaaagcaaatatgtatatattacatacatagtaaataagatttatatatagtaaaaatatgtaaacagtgattgttaatttaactaaaaattgtgatgtaactaggtgaaaaaagggaactggagatcagtataagataattaaatgtttattatgataagaaatgaatagataatggctaaaaaaatgaaaatcaagaaaaaaaaacccagtataagcatattacttagaattatagagttaattaccagcagaaacaaaatgacttgagaaagagcattcacaatgaatatatatagtatagttttgcagactgttttttgaataaggttttcagtataattttaaaattatatgtgcataatttctctatttatcctgatgggtgagttaaattgccctgacaacctctaaatcttgtaacaacaaagatgatagtgattgttgtttcccatactacatatcatcgacagggagctctgctgcacagcctcctcactctggtacagaaactgacagagttaccatcatggactttgttgatccttctggcagaaggagaaaggggaagagatggagagtctcacaccagcgaatcaacgcttggctgctgattggccagaattagtcacgtggctccattcaactacaagagggttattaagtgcatctacatgtgtcctgagggtggagagctacaaagagagagccagtatcgctaatggttgcctcaatttctctcataataattgttaagtaaaaataaaatagggcttggcgcagtggctcacgcctataatcctagcactttgggaggcccaggtgggaggattgctcgagtccaggagttcatgaccagcctgggtaacttggcaagacaccgtctcctcaaaaaataaaaaaaactaaaaaaataaaaaaatagccaggtgtggtggcatgggcctgtagtctcagctacttggaaagctgaggcaggaggattgcttgagtccaggaagttgagactgcagtgagccgtgtttgcaccactcgctcttcagtttgggtgacagagggagaccctatctcaaaacaaatacaaaaacaaaaacaaaaatggtttacttctagctaaaaatttaattaaaaattaaaaattcctatggataatcagcatgtaaatatttgtgtgataaatatgtaggtatataagcaaaatatgtatataaacaaatatacatatggattatatatgtataatttatatttttatatttggttttttcatatgtgtattattgagtccttaaacaaatgttttttgaatagcttctatttaccaggcattgttccaggttctgggtattcaatagtgaacaaaacagacacccctatttctgtgtagcttatatggagtggtagggacagagagactcagtaagcatagtaaataaatacattgtgtagcgtcttagaaggctctcagtgctagggaacaaatagtgcaatagcaggggagttcaatacagaggctgagaatatggttagaatttgcaatagggaaatcaggttagaaagggccctttgaggcaaggattgaaggggagtggggatagattcgtgggcaaatgggcagggaatgcaaatatcctgagactggagcaggcttgcgatttttccaggaatggctggaaggctagtgaggctgcagtgaggggacataagtgagatcgtgaatggggacataatagggggcatcatgtgaatatatgggatgtagagaccgtgctaaagactgccatactctcagttaattgattgaactctgagtgaaacacttgaatttacaccgggaaataaattgcccagcatctagaagatgattaatatttcatgtaaaccaacttggtcacactatgaagatggaaatgtaaaacttgttacttttctatccattattaattgcttaaagctcttccatgctttagataccgcactaagcatttatgtttcagcaaagtattggcataaaataaagcttacaggatggtgtgaaggcaatattttttgagtgtctacagcatgccacaaaatgacttcaatgcttagaataattgaattacataaatataatgtccccattttataggcgaaaatactgaggctcaacagacataaaatggcttgagttaccaggctacagtagaactaggatttcagtccaggtcagtctgaccccaaaaccttttcttttttcattgtttggatttagcacccccaaaaatgtcttgtaatgcagatttcctgggtccagggaattgtttaagtttttgttctaaaaactttcttatgaagcagattacatatggaaaatgaccctatggactatgagaattggcctttagagaatgtcactgccagccctgttggtatctataagaaccaataagcattatttacagagagtgatatacacagtgataattaagaaataactatatttatgatgacaattttgccaaatttactagaaaaaaataaaatatcctctgatttgagatttattgttcttttcttttgcaggtaagtttggaaattttttttgcttgtggaatagaggtatggtatcacttttttctgaattttattttaattgcttttaacattgagcacctttcataagtaatatgtttcaccacccattcggttgttgttgttgtatatatttggaaagtaacattgtgggtttgcgttatttgattcagaaattttacatatgtgattccatatggtaaatctatgcagtgtttgtatttgggtttgtgtttaaattatttctgtgtcaagtataaggaagaggattgtagtgcggggtctgtgtcagggaaatgggggactgtaaagaacagaggaaagaatatgcatgtaatgagaggttgaaaggctgagaagggcagctccaggcatgtaatctacaatggccatgaatgcatgtcatgaggaaaagatgccttttcaggaacaaaataatcaactgaaaactgttttcattcacttttctaagcccctagttttttgttttctcctattattgtgcaaaatttctggccagactattgctgacatgtacctttgaataaaaaaaatggctgtaactattctgaaacatgttaagttagaaagcaataaaatagatccacttcctggaaaaaagctcttattaactatatgtcaactatttcagataaggagtaggaagtttcagtaaagcttctagatacacaaaagagaggataaaatattagagggacttagaaagacgtgatatttgcactgaggaaagaaggtagcctgtaagttgaccacataggaccacggctttattattgtgcaccgtgctttcattagtatataaaagaggtgattgtgtgagatttaaatcaagcatgaacttaaactaaattccatattaattataaacggtatgtttactttattcaaaaaaagatatatgtttctcaaaataattgcaaatattattattaattatataaaaataaagaggaatgaggatactaatctactcacctaagttctagctaagagatgaggtagcaaaggaggaagaagttcttcagttcctggtcttgatgggtaaagcgatttgatctcattatattctctccaatataatcatattaatatcgaagtcatcagaacggagttgatattatcaagctaagtaaatattagaaaaataaaaattaacaaatggtttcactaaaactgcaaagtttgtacctggaccacaaagctaatggactggcctacaatggtctttgttttaactagtattccgggggttgatggaaagggagtggaattaaagggcattgtaaaatgtcatggcatccaatctaattatcagagctctagctccagggtcagcaaactttttctgtgacaagccagatagtaaatattttagccttttggggccacaagaactctgtagtaactactcaactctgctgttgcagagcaaatgcagttatctgtagacaatctgtaatgaatgagcataatatgttccaataaactttatttacaaaatgaaaaaaagtagtgggcaggatttgctctgtggtagttttccaacccctacctagctccctttgaaataaaaaaaaaattaagtaaactttagagattttggaacaagatgtatgttggcccccttcagatacagataaacacttggtctaagaatgaaatgttgttcaactggagttcagaaacaagatatgaacttctcaaaagctttgatgaatttaaacactagagggcacaaaaggacatttttaagtcaaggacctcttgtaaacagaacactacaattatgagaaactgcctgaagtagagcgatgtgacctcaatgtgcataatttgtttgaaatgtcagcctgtagctcttgtgacctcactgaccacaaaaacttgaagtggttgaccaccttcatgttgctgtaataatagccacatgtctttcttctttttttcctacttctttctcacttctttctctctcttttttttttttttttttgattgcttttggccctttcataaaatatggccaaaattgaggatttatatgatgggattttttttcatttcctaatagtttttttaattgctttagattctaattttcatgtggtgagtcctatttgtagtaaataagttattttgaattatgttgtgtcaatcttttataaaatcataataaaataatgcatgttatttatgcatatgatttatgcatataataatgtatattgacagatgtcatctgttacattgatttatgaactaatttgaaagttttatttcagaaaaatgcttaaaaatcagcagaagcttgaagcctcaaaattactcctaccctttaacacatggacacaaagatggtaacagtagacactgaggattccaaaagccaggaggggaaaggggaataagggaggaaactctacctactgggtacaatgctgaccacctgggtgatgggatcagcactgccccaaacctcagcatcacgcaatatactcatgtaacaaacctgtacatgtagcccctaaatctaaaataaacattgatatttttaaaatcctacctcttaatttagtaattctgcttgtagatatttggattgtggaagtaatttgggatattaaaatatttatattcaaagatattcaccgtaaaaatacctataatattgagaacctaggtatattctatgtatttcacatgaactaatgtttaaataaattttcatattagacccagccaatagaatcttgtcaaccattaaatatattttcaaatgacattaagtgatagagaaaatggcttatagtaaaccatgaatgcaaagcagaatccaaaaattatgtacatcaaatctcaattgaatgttaaaattagatgcgtaaatatatgtatatacatataaaaataaagaaaatgagccagatttacaagttgcctctcggtatagatgatttttaaaaaaatttaattttctgaattttccaaatttctatcatgaatattcatcattcatatggtcataaaaaataagtattattcaaacagaaaactatttttgcattctgacagcacttttttaggtgtgattcttagatcagtggtgctaaaagtcagaaggttataaggaaattatttatgtatcaggcaatcaatttaaatgaattattgattgttacgcagacacatcattagagtcacttttttagccctgggatgggatgatttgtctcaggtttgggtgttgtggcttagttgccgtgcactaggcagtgaagaccaggaaggaacaagggcctgctggagaggcctgcagtgctgatattgaacatggacttccctgtaagctccctggactgtggtaaagcaggacacatcacacacacacacacacacacacaaacacacacacgtggacacacacactcatgctcctctatcctttttctcttctaaatctgctttctgcccttgcctttccctataaatggatgtgtgtggagaggagctggagagacagcaggggtctgaaggatgctaacttggactttttcctgagcaaagaattccttaagaatgacctggtataaaaattttgaagaaatctcataaataatatgggcaaaaatgtgacagcaatgtggcacaatgcaaaagcttgtcactagtttcagcccagcttttcctcgtgattgttttgagtagcatgaattatcctctaaaatgttggtttttattcctttttcattttgtacaaacatacctaaaagggtgaacatagtataagcaaagacacaacgttggaactataaggaataattttttcttaattcactatgtatttttctaacacttttcttggagcttttaatccttagaacctaggagatggaggactatacactcgggtttacttttctttcattttcttcttctgaattcttttttttaacttttaagttcaggggtacatgtgcaggtttgttatataggtaaacttgggtcacaggggcttcttgtacacattattttgtcacccaagtattaagcctactacctattagttttcctgatcctctccctcctcccaccttctaccctctggtaggccctagtgtgtgttgttcccctctttgtgtccatgtgttcacatcaattagctcccactaataagtgagaacatatggtatttggttttctgttcttgcattagtttgctaaagataatggcctccagctgtatccatgttcctgcaaaggacatgatctcattcttttttatggctgcagagtattccatggtgtgtatgcaccacatttttttttatccagtctatcattgatgggcgtttaggttaattctatgtctttgctattgtgaatagtgctgcaatgatcatacacatgcctgtgtcattataatagaataatttctattcctttgggtatacacccagtaatgggattgctgggtcaaatggtatttcttttttaggtctttgaggaattgccacactgtcttctacaattgttgaactaatttacactcccaccaacagtgtataagttgactttttaatactagccattctgactggtgtgagatggtatttcattgtggttttgatttgcatttctctaatgatgagtgatgttgaagactttttcatatgattgttggctgcatgtatgtcttttgaaaagtgcctgttcatgtcctttgcccactttttaatggggttgttttttcttgtaaatttgtttaagttccttatagatgctagatattagacctttgttgaatagtttgcaaaaattttctcccattttataggctcactctgttgacagcttcctttcctgtgcaagagctctttagtttaattagatctcatttgtcaatttttgcctttgttgcaattggttttggtgtctttgtcatgacatattttttttttttttttgagatgggtgtctcactctgtcacccaggctggagtgcagtggcatgatctcagctcactgcaacctcctcctcctgggttcacgccgttctcctacctcagtctcctgagtagctgggactacaggcgcccgccaccacgcccagctgattttttgtatttttagtagagacagggtttcactgtgttagccatgatggtctcgatctcctgacctcgtgatctgcctgcctcagcctcccaaagtgctgggattacaggtgtgagccaccacacctggcctgtcaggacatcttcacctgttcctgtgtccaagatggtattgcctaggttgtcttctgggatttttatagctttgggttttacatttaactatttaatacatcttgagttaagttttgtatatggtataaagaaggggtccaatcttctgcatatagttagccagctatctcagcatcatttattgaatagggaatcttttctccaatgcttgtttttgttaggtttgtcacagatcagatagttgtaggtatatggtcttattcctaggttctctatcctgttccatttgtctatgtgtctgtttttgtaccagtaccatgccgttttggttactgtggccctgtagtatagtttgaagttgggtggcatgatgcctctagctttgttctttttgctgaggattgccttagctattcgggctcttttttggttccatatgaattttaaaatagttttttctagttctgtgaagaatctcagtggtaatttattaaaaatagcactgaatctataaattgcttcaggcagtatggccattttaacaatatggattctttctgtccatgatcatggaatgtttttctatttttttgtgtcgtctctcatttgtttgagcagtgttatgtagttctccttgtagagatttttcacctccctggttatctgtattcctaggtattttattctttttgtggtgattgtgaatgggattgcattcctgatttggctctcagcttgactattgttggtgtgtaggaatgctagttatttttgcacattaatttcatatcctgaaactttgctgaagttgtttatcagtttaagaagcttttgggctgagattatgtggttttctagatataggatcgtgtaatctgcaaactgggatagtttgacttcctctcttcctgtttgaatgtgctttatttctttctcttatctaactgccctagccaggacttccaaaatgttgaataggaaaggcgagagagggcatccttgtcttgtgcccattttcaatggtaatacttccagcttctgcccattcagtatgatgttgactgtgggtatatcattgatggctcttattttttgagggctgttccttcaatacctagtttattgagagtttttaacatgaagcgatcttgaattttatcaaaggcattttccacatcttttgagataatcatgtgttttttgtctttagttctgtttatgtgatgaatcacatttattgatttgcatatgttgaaccaaccttgcatctcaaggatgaagcctacttgattgtggtggataagctttttgatgtgatactggatttggtttgccagtattttatggaggattcttgcatcaatgttcatcaagaatattggtctgagttttaaatttttgttatatttctaccaggtatttgtctcaggaagatgctggccttgtagaatgagttagggaggagtccatccttctcagttttggggaatagtttcagcaggaatggtaccatctcttctttgtacatctggtagaattcagctgtgaatcagtctggtcctggggtttttttggttggtaggctatttattactgactcaatttcagtgctttttattagtccattcagggattcagcttcttcctgattcagtcttgggagagtatgtatgtccaggaatttatccatttcttctagtttttctagtttatgtgcataaaggtgttcataatactctctgatggttgtttgtatttctgtggggtcagtggtaatatcccccttatcatttctgattgtgtttatttgaatcttctctcttttcttctttattaatctagctggtggtctatgtagtttattaattttttcaaaaaaagaacaactcctggattcactgatcttttgaatggttttctgtgtctcaatattcttcagttcagctctgattttggttatttcttgtcatctgctggctttggaatttatttgctcttggttctctagttcttttagttgtgatgttaggctgttgacttgagatctttctaactttttgatttgggcatttcatgctataaatgtctgtcctaacactgccttagctattttccagaggttctggtatgttgtatctttgttctcatttgtttcaaaaaccttattgatttctgcttttatttcattatttacccaaaaggcattcaggatttcaggagaaaaggcattcaatttccatgtaattgcatggttttgagtgaatttcttagccttagcttctaatttgattgcactctggtctgagagattgttcattattatttcagttcttttgcatttgctgagtagtgttttacttctgattatgtgatcaattttagagtatgtggcatgtggcaatgagaagaatgtatattctgttgttttggggtggagacttctgtagatatctatcagatccatttgttccagtgctaagttcaagtcctgaatatcttaatttcctgtcttgatgatatatctaatattttcagtgatatgttaaagtctcctgctattattgtgtgggagtctaggtctctttggaggtctctaagaacttgctttatgaatctgagtgtttctctctgttgggtgtgtatatatttaggataattagatcttcttgttgaattgaaccctttaccatgatgtaatgcccttctttgtcttttttatctttgttggtttaaagtcttttttgtcagaaactaggattgcaacccctgcttttttctgtttttcatttgcttggtagattttcctccatccctttattttgagcctatgtgtatcattgcatgtgagatgggtctcttgaagacagcataccagtgagtctcgattctttatccagcttgccactctgtgtcttttaattgaggcatttagtccatttacatttaaggttaatattgttatgtgtgaatttgattctgtcatcatgatgttagctggttattttgcagacttgtttatatggttgttttatagagtcattggtctgtacacttcagtgtgtttttgtagtgtctggtaatggtctttcctttctatatttagtgtttctttcaggagttcttgtaaggcatgtctggtggtaacaaattccctcagtatttgcttgtctgaacaggatattatttccccttcacttatgatgcttagtttggccagatatgaaattgttggttggaatttctttttaagaattgtgaatattggccctcaatcttttctggcttgtagagtttctgctgagaggtccacagttagtctgatgggcttccttttgtaggtgaccttacctttctagctgcctttaacatgttttctttgatttcaaccttggagaatctaatgattgtgtgtcttggggatgaccttcttgtgaagtaccttaccaggagtttctgcatttcctgaatttaaatgttggcctctctaactaggttagggaagttctcatggataacactctgaaatatgttttccaagttggcttcattctcctcatgtatttcagggacaccaatgagtcgtagattcagtctctttacataatctcatatttctcggttttgttcattccttttcattctgttttctctattcttgtctgactgtcttattttagaaagccagttttcaagctctgagatttctgagattttttcctccacttaggctgttctgttattagtacttgtaattacattatgaaattctaataatgttttcagttctatcaggttggtgacattcttgtctatactggctgtttgtctgtcagttcctgcattgttttatcatgatttttagcttccttccgttgggtttcaacatactcctgtacttcaatgatcttcattccaatccatattttgaattctatttctgtcatttcagccatctcagcctggtttagaagcttgctttagaagggacacggttgtttggaggaaaaaaggcactctggccttttgagttttcagggttcttgtgctgattctttctcatctttgtggacttttctacctttaatgtttgaggttgctgacatttgaatgttttttttttccttttatcctatttgatgaccttgagggtttgattgtggtattaggtggattcagctgattggcttcatttctggaagattttaggggtccaacactcagctcccaacttctggactgtgtgcactaactctgggggacttgtatgaggcccaaactttgtcttctcattcttcaagttttggaatccactcagctaggggtgctgagatgggacagctgcagtgaagtgctagtgggtgtgggggtgcctgcctccttgcagatgttcaccagagtggcagaggcaatgcagcttacagaggtgggcaggaggcccttgctggagcctgtgtgcacagtcacactggaggtggtgttggctgggggtagggtggtggcaggcacaggtctgaatgccttctctgtgccccacaagcaggagtgatagctcagggtaggggaggattcactgttctctgtacagcccacgtgtttacttttcaaataatttgatgaactgagtgaaaatattgaatttagactagctgatttcattaaactatgcttaaaacttcaatttatacaatttttttcttcattttaaaactttgaaccaaattggcttgtaacataaactaatagattcaattagttatttggaattattttcaaagatgtgtccaacattctagagtttaaagtttatatcctcaaattacaattgcttgtaaagtttactggtttatttcctcaaatgatcattgctggtttatgtatatgaaatattctcaaacatatcaaggtacagataaagctatgagacacgtaagcttcttctgttgtccattgggtaggtagagaaatggatgacttggcttatttaagctaattactaaaggaaatagagaagccttgagtcctttctggaacaaaacagaattaaatattcattacatgagggaaagcataatttagaacaaaataatgaaatttccctggagtctgtcttctaagaggtttgatggattcatttaacatacatttatttcactcctactgtgctgggcagtcccagggttatacagccccaggaggttcagagtccagtagaacatgagcatataccactctttttctttacaatactcctttagagaaaagaagactgcagtttgcattttgccctgggtaagaaacaaattagagatgtaaagaaactttgctaagcactacagatgcctttgacgtgtttattcccgttgactcataactgtgtctcaccagataacctatagtatattcataccgaaacttatctttttctaatactttagttattagtttttaggtaacctgaagaagaatgaatatgagcttttcatatctatagtaggttcacttccaatccagagaaaccatggacagacctttttttcagctaaacaaagtgtggtagtttaacatcgcagtaagatcaaaaaccaccttaactgagtatgaaaaatatttgatgatacagtagtcttcaaactaagtttaaaagatgcaaatagtacatatatgccagtacatatgccagtgtcttgaatactgggaaaaaggaggattcgagtgggggaaagttcacgacattgtctctctgcctctaatctttcctgctcaagtccttgcaagtagaatcaaaatatcaattgttctgaaattaattctgcttttattatttcactcccttgttcagagaaacttggtaagttttcacttctaaatggaacaaaggtcccactcctaacgtatcattcaagttccttcacagtccagtctcaacctttctttcctttcttttcctaactatcattgttcataatacagtaatataccctcccaggagtattcaatcttttggcttccctgggccacattggaagaattgtcttgggccccatataaaatacaccaatatgatagctgatgagcaaaaacaaaacaaaaagtctcatgatgttttaagatagtttatgaatttgtgttgggccacattcaaagccatcctgggccatgtagcccacaagccacgggttggacaagcttacaggtctaaactctgataatttcactacaccttggatattcatacttctggtgagcagaggctgcttacactttttataggccaatatcaatcataacgtttaagtgtttaataagtatcaatatttatctcatatggctctcagaacagtgaattaattcacttagcaaatatatattgaaccattaccactatctggccctattctagttgttggccaaacagcagtgaatcaacatgtctctcctctgaaagaatttaattttttgtggggaggatagtacaaaatatatgaaatacataaacacattcaaaatgtgtgtcgtgatggttagttctatgaaaaaaattagtgcagagtaaagaaatagtaatacgagtgtgattttagattaaaaagtcagaataggtatccctgtctgttaaactgacatttaaatcttaacaaaatgagtgaattatgcatttttccaaaggaagagtgtttcaagaaaaagaaatagcaagtgcaaagctccttaggaggaggcacattgtgtttaaggaacaggaagaagttgagtattgtgggaactgagtaagcaagaaagagaatagaaaaggaggccataaagagaggagagggcttttgaaaaccatggaaaagagtttggattttatcccaaatggagagggaaactagtaaagggttttgagcagagaaatggcatacattttcaaaggatcactctgggtgctctgtgaagaatagagtaggagcaagagtagaagcagggaaaatggttatgacgccactgcaatagccttggaaggagacagtagtgacttggacccgggtgatggcagtggagatggcgagaagtgatcagattctggcaatgttttgaaaccagagctaattgtgtttgatgacggatttttacatagagtgagagaaaaagagatgagtcaaagataattcaagggtttttggcctgaacaaattggaaatgtgtgtttttatttattgagcttgaggagttcaagggaggagtaggtttagtggtggggtggttctgtttgagcattttgagtttgatagtcctgtttgtggaaaatgcttggagtgctgccccatttccctccacccactatagagttcacctgaggctatggcagactcagtcagtttcccatctcaggcacctgggggctttctgcagtacaaaggagcctgctgagaccgtttacagaattttttaacattcccagtggcaacactccaacattgagggtccagagttggtgctcatataccccaggttccacattctccagtgggacagtcctgaggcatgtgtatatatggtcccacaaaaggtccctggggagattgggccccatctgcccctgcttattaatacacactgtattaacttttcttcctttgctatcccacttctccatcacctaactttgatttcctagaatcgccttcctgcctcttctccaaataaactacgcactccaatattttgcagtctccctggaaggaattaaacctaagactattaaatacccatatgtcaatctccaagaaggagattgatatactattctgaaaaccaggcaaaatgtcagggatggagatacagttgggaggcgttagtctttttcacaagcctattcaaaagcccattgcacaagcactagatatgtgtagattcctacacagacttgttaccgtccttgtctgcctcatgtcatctcttccacatgaatacaatgatactcatcaatgaatgctctgaactttcagcaaaggccacagtagaatttctagatagtagtagattgagaagtgatgacaatttgattggaagctaagggatcttggggacttgtcttgaatttgcatttacatagaaagcacatcgtttttatgtttgacacatatttatttgtggtgggtttggaaaaccttgtagcggttatggaggggcaccccaacccatcctttggtgttgccattgctttttaattatgatttgtgctaagccacacattctcattttacctagctcagggttctaagcatgtttttcatgatggtttggttaggaaagtgagtagcaatgaatgagctcctcaataaatacatagcacagacactgacaggcaaagtgaagtttgtaatcacttcccaatcaattgttcaactgaatgtgagaagaaatcattttctctcctgttttgagtcagaatatcacataaagcacaactcttcctgcatacattgtatcatattccacagtaatttacttttttgcaagaagtatccaaaatttggtttttcctgctgagcagttatccagataattgcaaatcagtggaatcatttacatgaataaagatttttattctaattaacgtgctaaatcaagcacaccaaatgtctctaattcttatattactcaaatggcaatatttttgtcagtgactatcatatgaaatttcaggtgcctaatgcattttcaaatggcactcataagcatactaacgttttataaataaatgtctccatatttttaagatgaatggacaatttttgatttttaatgtagtccccaattttcaatttttcaattttcatttaccgaatggagaaacagcattcatcagagcaaaagagcaagtttcacaagtcatgggaacaaacatagatgctaatttcctattttaggaagttctttttaaagtattatcattaagaagcacaactctgtggaatatttatgtgcacatttaataatagagaattcggatgtcaagtctgtgtgttactcatacccatacatgcatcctcaaaaagccttggaagttaatcctcagctgatgaaagctaagcaattgctctggaaggatacttgaagtttttggctcttggggtgaaggtacagtcacgaaaacctctcttcacaagagggcgctgtgcaaacagctagctcctcgtgaaggaaaattgccttgcagactggcacgaagtggatttctttacatctattaagtgctctgctcttcataaaggaaaatttccttgcaaactggcacgaagtggatttctttacatctactaagagctctgcttctttctctctctcttgctttttccttgccatgcctcttcttaggctctgtaaggcagacttcttgtcttctctagttatgcttctgcaaactgcatcatgctgattctattaatgatttgattttaaataataccatcataggtgttaaatgatgtgtatgcctatctggcttctcaggacttctctctcactactttacatctcaccaatgtgtaaaatatctatgagacatctttaatttaatatgattcaaaagtctttactcttgacctttgtttgaagtctaatcaactaaaaacctaaaattcctggtgggaaaaaaagaaacttgactactctagttttttaataacatgtatttcatttattctgattataaaagtcatctttatttattgtagaaaatataaacattatggaaaataaaatttaaaaacatctatcattctattacccagaaataacttgatcaacattttggtgcatattttaatgaatagatttttaaatgagaaatgcttttcaggagtaattagattctacttagtattgacaattttataatatgcttttaaacaaagtattaacattaacttttttggaaaatgccactttctgctacttatagctgtattggctattttctcagaacttctgctgtaatgagtttatactagagttgcaaatacacgttctttgaatgtacttgaggagtcgatagtctgaatctgagattttccacagctcttggagcacctgagaacacactagcttcttccacgattctgcagtacttgctccttcctgataggatgcctttgtaagcgtacaactccaaacatgggctgagtgttcagtaatcatttgtgttgagttcttcagtttcatggagactaaaattaggttttctctgtcactcttgtaatgtcatctgaccttgacctgcatttcaaattgctgagaagttagcaagctgacttttacactaggcacatcagaaataattgattaaaaatagagttattgaagttgaatttttttcatttatagaaaagtacaatgtcttgttcatgacaaacaaggcctaacatttatataatgttcatttaaaatatatcaaaagaaaacaaaataataaaacccacagaaaacccaaaaacaactcacctattaaaacatctcttgatttataaatattatagtttagtttgtacaatatcagtaactgtggaaagctcccaattatctcattcccaagtgcttgactgactcataacttaccaacaattttcttatttcagagaatcccaaaaacatattacctaggactaacctggaataaaacttcatggttgatagcttttatcaattaaatgggtattgatttggataactcataatcttgagcatatctttagatttactttttatcctgaatttatttttgttagtaagatttagaaattcagatttattttgtgctttatatgacatagaaaaaaacaaattgtctttcctgtacaaagtccacccttcaaaatagactccagaagaaaacatagagacttataacttaggttaaacataggcacaatcctaaatagtattcagatgagtcttacctgaataattgctcacctaatatgataatcacctgttaagaagcagtttcttaaatgtcactgttggaatctaaacagtagatacacaggtgttcactgtaaacttgtttcaatttttctgtatttttgaaaatgttcataataccatcttggggggaaaaagcctctttttgacatggcaagaaccatattctactgaaacagatcttatatgctctatcaagtttatattttagacatccctaattcagctcattctggactattccaggactgattgccctactaaggcatgcttatttttttctttatgtgtataagaaggattcaaagggaccgtttgtcagttttaatgtgtgagcactactgatatgttttattgagaaaaagcttactgccacagatcacagagatatttttccgaggtaagattcttgctggtttgcaagttttgtaaggaggcaccaggacccatctctgtacccccagccacggagcccttatttagacccacactgggctgaaatagaaacttctgtacaaatgtatctctcctgtgctctttccactttaacagaatagaaagaattgactggttgagcccaaatatttcccccaggccagtgttacaaactggcgtttcaccaaaaataactcatttgatatgtttttaatgttgatgatctgaaaaatcatcttcttgtttttgtttgtttgtttgtttttagagatagggtcttactctgtcagccaggctggagtgctggagttcagtggcacactcacaactcactgcagcctcgattcccaggttcaggtgattctcccacctcggcctcccaagtagctaggaccccaggcatgcaccaccatgcctggctaacttttctcttttttgtagagatgggatctagccatgtttcccaggctggtctccaactcctgggctcaagagatctgtccgccttggcctcccaaagtgctgggattacaggcatgagcttcatacctggctaccttcttcttaattatatacattttttcttaaataagagctcatgttattttttatttctataaatattttatattccttctcttcttattgccctgatactttaaataaacctaagcccagtcaaattttgtattacccttgagtttcagtttttggttcattcagccctaagttctctttgggcatgaattgttttcaccattgactactagcaggcagctggcatagcctgggacatgtgaggtgatgctaaacatgcatttgtgagtagaaggaaggaagaaaggagggaaggaaggaaggaaggtaggtaggaaggaaggaaggaaggtaggtgggtgggcaagagagagggaggaagaaaaaaaggaagggaggctggttggtttgattagctgttgaacaaaattccatatagaaagtagcttactagtctatatcttttagctctgtttatttcaaagctttgtgtgtttttgttagggtcacttatagaatatttagaaaaatacttgctgcctcatgcatttcaccatccagtgcctggtgagacctaaaagcccatagttataattttgtttctttgaccaaagtttgttttattttcaaatataaattcaatcccttaagactcacctatagcatatatatcaaacaaaaacacgtcaaatttaactcagaattttgctggataaatgattttactggatatcatctgaccaatgaaataacaattgtgtgttctcaaatttacttctacatttttaaggtagtaagtttaattaaaaatctctaatataaaaatggcttattctctaaaatttagaggtaagctaaagttttcatcaaggccccattatttagcactttccaaacttgggaaggtcacttaactccactgaaccagtagaaataaaattagtggtaacactgaaagcaaaaaccagaaccagtccaattgtcttattaataatagcctaattgtgtaaatgtctgttataaatttcttagctggttctgagagatagctagtaaatggcaccctaagttttatatattctgttacaaaacaaaaacaaataacaacaataagctgttttcttttgctgttactcaaacatctggatttctattgtagcccctagcacattgttacctttggttggatggactgaaaagtgttgtgatttttctcctatgtagaatattcagagggaaagtgcagggcagtgcacaatgcatacaaacattgacaggatcacttttcctcaagctgaactatactctaggcctcctctctctctagttaccacagttgaacccactcagcccctacttgcagcctcagtcccaccccaggctcacaggccaattttgtcctggaattaggaattgaaagatctcaggtaagccagccacaatggagacaagatttagagataagcaaaactgacttggactcacatgtctgtcatatattacctctgtggtgttagccaagttccttaacctctatgagtctcagatttctcatctataaagtggtgataataatgtctgctcgtgagttggaagattaagtaacatgtagatcttatacctgacaccaattgtttttcctgtgaaagttcaaaacttctcttatgatttaattcttcaaggaaggtgacctgacctttttcattcctgtatttacttatattccaggcatgtattggttaagatatacattttgcaattaagagggacctcaattttaacctcagatctgctactcattggctgtatgatcataggggcaagttacttcaacttcgtaagtcttcgtttcctcagtggtgatacagaataaaaataacacaaagcacacagataaattattatgaggataatatatagtataccctaaaattctgtgcagagtcttcagaacactttcatgttagttaccctattcagtcctctcaaaagctctttgcaatggctctctctcaaatgagaaccaaatggataagacattataactcagcaaggtcaataaacaccacagaataaacaccaaataagtggttgatatcatcatagtaaaatgaggaattagaaaagttaacccgacattatggtgatgtttggttcacaaactcattcagtgcacaggaagtgtccaagtaaggaaggggtctgaggatgacaggtactcaggaatgggaaagtttatgactgttggctccaacaaatggataaccagatttagcaagatattgaacagtcacggaaaaaatccacagcaccaaaatttagcacatgagatttttatttagggattcttggtattgggggtcttttttctttctcccaagggagtgattttgtttctcagcctagcaatttcatcactgcttttgcttatttgtaagcataattctaaaaagttgtaagaagccatttctgtccttatttggtacgtggccaacaataagggtagcatgagttggagtcagtgttgcaactggtttcccaattaaacaacctgtctctaggatcccataagttttcaaaaaataagtagaaacatttctatatttaggagaagcttagggttttgagcaatcgagaaattctatcacctaatttttgtaaaatttcttgccacctaattttttttagatcttgtaaacaaagttcttagagggttttaatgctgcaaataaaacattaacatttcttcatatgattaaccttcaagatataacagctaatattttattcttacacacatgggatataaagatttcaaatagagaaaagtgttatctatcaaaactgaggactgatattctttttgaaactgataaagtggtatgcctatttaccatgctcatgaagtaaccaattggcaatttttagaacttaaagatgtttctaacagtataaaaatagttttcctacctctcccaaaagcttacaaacatcagtagtgtgtgcctaaaattttgtccagttttcagaatgtttttatataaattgccttattcagccctctccaaaactctttgcaatggctctcaaatgagaaccaaatgggtaagacactgaaactcagcaaggtcaggcaacaatcttcaaggtcacatggcaagttcatggcataactgtgactctaatctctaatcccctatacagtgctgccctgaaaacttgcccaatggtattttgattaaaaaaattaattaatcaatcaaataggaaaaagaaactaaataagccctacctaaattacctgttctgaaatttctgcccctatttaggcacatataagaatataatgtaaatgctccatcttatttttaagatgccctgaaaatattggtttgtccatttattaaacaaacataattgtggtttttatgtctctagactgtttgctaagcactgagtacccagagggaaagcagatgttatccatgttctcatagtgtttaggtctatcaggggagccagataccaaataagtcattactaatgtgatgacattgacaaagaggaagtacaaagtgcagtggagacctcacctggtatggggaggcagggaagacttccggaggaagtgaatttcaagatgtaatcctatatccaccactccttcactcaccagtcaatagctaagtaggatttttatttaagactgtattcatgagtagaatattaaatagaaagaatttttatgacttttaaaatcttcatatacagagaattgaacaagacaatcagtgacaccagaagacttttacacacttgttagaaaattgtgtcaaattatttatttcaaatgattagtctacattgatttcaagatttttaaagaatttgagtctagaaatattttttgaatagttagaaaaatctcttaggaacttgtcagtcatttagtagatattcaataaacataaaatttattttcttttccttccatttcttcctccatgatttctttccttcaatcccatttatccaagtaggctttatccaacaaagctttagaaggagctttgttagtttagtgaatagaaaagcttgacttagttgttttccaaattgctaaaaaaaatcctaaaattaatgtagatggaaaccttaagtgtctagtaaaacattttgattcacaatcatagtcatattgattttttatcattatatttaagcatgcctcttattgattgttttagtctatatcctgattttagctctttaattacagtttgtgtctgtttgtgtcctgggtcatatatgagtaatggatgcaattgtagaagcttaaaacacagagcatgctttcccagtgttcttaagaccatggggtaccttcaattctgttaatgttttactgttgccaagtcttaaaataattgtctcccatttcagaacatggaataattgacctttcaatcaagtagactcatataaggtttagaatgaatatttgaaagcaattcaaagaaaattttggtattattttgcaacacttccattttgagaaataacttatagttgattttgataagtaatgtaataaaaatcattttttacatttacttgtactgaatggatattagttttaaggagtacacaagccccgttatcaaactgccttttgtcacactcttttgcaatgtatcattctgaagatagaattacaacgacaccctcatcagaagtagatggtaaataacagtctgttatttgcttccacattaacttctgctggctttgagtctgtaaccagagactatttcaaaatacagcactatcctgaaacccactatctgcctgctctggtttcctgaagcaatgtctttcaacctaacgcaaccccactgatgtaactgcttatttctctgaagttcagctcaaccctcgtctcttccgtatgcctgttaactagagacttgatgcgcaagtaattgaatgcctatgtggattacgtttaacttatcccactctcaaatttgggagtttcatttttattcatagtagctatctcctataaaggaaattctgagtttctgtgtcagacaccgaaacccaaatttgccatttgtaacatctggaatcttggaaccaaaatcccagaaatattcaagaggcaaaaacgatgccttatttagagctctgcagaacataagagctaagttattggcaggagacgggcactttgctgatactttagtggggttaggacttacatggataacaattggattggagcaatgtttagatttccgaatctggttttccctaggacatataaaattagtgtgcacaacttgtaaacataataatttgtctcagggatggaacatctctccttgctattgaatcatgcttttactaaaattcatctggaaaaataaacgcttaataaatgacagtaattagaatgttcaaaagatgtcttctttgttcttttatactctttgatacccatgaagtaaaaattataaacagcttgttgtattataaatgctagtaaagattcatcctagaaaatcattttatttaatttcttattttttccaaatgtctaaattctcatgtctgtgaaatattagccagttcttcaaaaacaatattgatatttctatttgaaatcaaggcttaattttgctcatgattaatctcagaaataagtagcttatttctatgaccttactgagacctggtaacctaagaaggattatgtgtaactgtgtggaagaaatgaaaaggaggcggtaagtaattatttaagaaaaaataatattaatattgacagacacttcttgtgtctgtaactgatttcacactaggaaaatgaagcagagtttcaattttcttgttcataatttcacatttacagttccattgttttatcttgcttaactgttctagatgactgcctttacaaagcagggggaaaagaaggaagaaatgtttttgacagtaatgaaaaagacaagattagttctccttccttgcacatttttagaaaaagttggacattccctagcagattcattctagattattcgtatgtccttgtagcttatcaattagatatccattaaatttgaatatccctttaaaaaggtaaatttgtaagcaaaggcagttaattatttgtgaaaatgtatactgctggctttagcctgaatacaaagatagggtttatcttgctatcagtaaaattgggataacaatgaaaatatttttctgcttccaaagtcgtatacataaactgtagcttttattagaaatcagtgatgctgtttcacctacaaaaatttaaacaccactggacaaaatgagagctttgtgttgcctggagggtgaaaaaagtccatctttgccagcaacatcccttctactcttctgcttgtctttgtggcctccctccccctccctttcacaccaagccacctcaccccaccagctgttagggactcctcccctctttacgcagatcaccagttatcttacactgtctggctttagtctcagatgaagacattctaataagcaccaagttgttcagctcagtgctaactctgccaggaatgtgtgcatttcctaagagctgccgaaaatggaaattaaatagtttgaaagaattaaatgataatggtggcatttcatacaccagaagggcagattggcatcagtgtaagcaccttttcagtccttctttgagaacaccaggaaagtggctacctgttttgctcatgcgaaatttggatctctatacaaaagcaaaaagacagtttgtgaagcgttacaatattgcaagttgattcagggagaatgtgttgtgtttatttttgaactctctgctcctccaaggttgctgctgttcagggcagttctcactcacccactttctttgagctcatgtctgataagaaagaggtgaaactgtaaaaaccttttctattactcgtctccaaagctgatatgaaacctgtagcattcttaagaacccctggtgtcctggatgctgttgtgaaaacaagcataatgtttaatgtcttgagcttttattgaaattatatgaatattcaagactcccttggtgtacaagagacagattgagctttagaggtctcaaaatttgcagatatggtgatgttcactgagctcaactcttggtcaattttgtccagttcagagagggttaaattcactcttgggcacttgaagcctctctaatcttatcctgaagaagtggcgctctcccttggtttacagttgaggtcacccgcggggcagtgtttggatacagactgatgaaattatgctgcattgttaacattgaataccactcagtggtgaggaccgatgacggcactagggtcctttgactccttgggtacaatttcttgaaatagatgctttcccaaaatgtcctggactcataaaatatatgaaggattctatttggctttcatcatttatttaatttgaaagaaagttgttttaacagatttatcagagttaagaaatgtttctagggaatagaaaatggacaagataattgatctttgttgtcagagtcatgcattgtaattcactctctaaggtgacgcagcatctccttgagggcaaagctgccaaaagttctgaaagtgatctgcctgtttttttttctcacactgacttttagagaggcgctggtattttcaagacgagtaaatcctgtttacatcctgtggaaggttggctaagaattatatccatctctttttaagagaagttgaaataaggaaaattatagttggcagttagctgtgtgaaatttagtaatctttgtcagatgacccagtcataggcatgtattttttaaaattttttaacgaagccctgtgggtttacattttttaaagttcacactgatataaaggtttacccacttcaatcacaccttttgttgtgtgtgcatgcgtgtgtgtgtgttgtgcttttcaggagtggcatgtgactatgctgtttaatcagggctatatttaaaaacaaattttcgagggagtgtttctcacgttaattatgagataaggcctgagtgaagcaaactctgtcgcaaaggccaagtgtcatgcagcaggaagtcctggccatcccttccagccctgcctcagccagcctgccatctctctgtcagcgcataccactgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacaggtattactcttttccttttgtagctaggaagaattgtttaactgccttaggccccttgcaaataagcctttgccctatgttgaccttctaactcctaatgcttgttaaattgacaatatattaaataagagccaagaagatgatgtaaaccttgaaataggggtatgtaggtacgtgcagaagttgaaggaagttgactaactttaaaagctaattctgagagttaaatggcaaacttaacaaagcattcatattactgccacctgaaaaacagtgtattaacttgtctaatggcttaatacagtcaactctaaatgttagggaagggttcttgtttgaccaacaaaaaaaacactacattattcttcataagtgtttcagggcacatgcacatgaaaaaatggaaactaatgctgtttcaggtagtaattcagtgttcatcttgcccagcagaattacatgtcatgaattcaaactaaatattttaataatcttttgtttctggaagtcatattaaaaatcttgacctcatgacttcactaaactgtcaatgactgttttacaacaaaatcagcttattttaaccaaataactggaaagaaagaaaacacttaaaaaatattggatttccttcttcatttgagtattctaggtgttaataaagagaagattgattattctttattattgtttagaaagaaaaccttttctgtttttgattgattacaatctatagcactgaaaggtatctatttaatcaatagtaaatagaagtgacattgtttgcaaaattttggatataaggtctttcttatttagaccaaatgcagcacatctggaagctgccaagcctatgtagaaatatatattaacactgaattaaaatgtgttctgatttgcctgcatataaaacattcaaagtttgaattaaaataatttataaggattaattatttgctttagacactaaagaagataatgtccttggaatttttagggaactataaaatcagagaaatcaaatttaaaaattttgtataacaatgcataagcaaactttggcaagaggtaaatataatttgccagctaaaggtataggtattaactccatttatttttatttcaaaataaaataatgatttatttgttatgtttgttacagctataaaatttagttgaaaattttaaattatatgcttcctatgtgctttgcattttgttaaatgtgattctcatgcttattgtatgctaaattgtacatttagaacttaacatcaatgatttgctaacattactgtgcatatttccaacatatggtggcttctaggctctcttcatcactagatctgataacaagctccttaatatcataaatctccagctgctgaataaagtaaaagcaatagcttgattgactaatgaatttgagaaatctcacgaaatgcagagtttaagctcttctgtgtagtttgcaaatatattataaaccttgccttctcaatttggcaaagatatttttattttgaggtgttatggtattgtaacaatttaaagctatatgataaatatattttttcaaggttcctttggtcaagttctgaccctttccaaaatataagcattagcagctaagaatgactttttcatgtatttgaatacctcacatctgtaattttaacaagtttcatttgtaacaagtttaagaggtgagaatgacatctcaaatatccatcatgagtcagtttccttcggaagcttgagaggctcagtccttcctttacttcctcttaatttgaatatacaatttcccacagaataattaatttttttatatgtgctgctttcactgtttggaggttctagtttatctttccagttgcactgcaaactctttgaggttagaagtttccttacatacagcaaaaatgccagtaatgcctatttgataaagtattctgttaccctttcttatttggcatcacccgataatgttttattggcatagccaacttgatatgatcatatctatcataagttgaattgagtggaagggttagggaggtaggaaggcagttggccactggctcttgcatttctgcaggtccctcatgtatccaaaggagattacgcattcagccacgacaatgtactgacaataatgaaaaaaggtacatatcatataacttaaaatttttatcataccataatacctcaaatgcaccatgagtcactctatatatatacagacacatatacacaccacacacaggcacatgcacgcacagttaaatgctataattatcttctgaagagcatagttttattgcatagcattcttggaattaaaggtgttaaactatttgatgtaaacatgtaaaatatctcataatgtcacagccttgtttttgcatttcttattttttaaaaaatatacaaaatccttacgcggtgaaagtaacttaagcttatcttgacctttaagaggctttggatctgattccattattgaagcaactgaaagaactggacattggacaacatttcttcattgaatttctcccttataattttttttatgagcaatattttttatcttgtaaaatcttcaaatgtgcctattgtagtgtcatttttctttggctattgaatggataataatgcatgctactgggggtacacttagctttaactggaatatttttccttggcatggcttttgctgcctggtaatattcaggctaaaggaaagccaggtgtacaagatatgaaattcaattagtgtctgatttgttaaagtaatagcaaatcatatacatttaatgagtgttgactcttgagaaatacaatctgaaacagttttacaatgctcaaaatagatgtgaaagtttttcagctgtgacaattttttatcttatgtgggtaaaatacatttttataagaaaagattaatatatagcttattaagtttgattgaggcagaaagaaggattgaaagagaaaagaagagggagagggaaggaaaggcaggggagaggaggggagcagggccgtggaaggaggagtgaggaagagaaaaagagagaaagcagagggttacataataaggaaggtactttttctctgtgagcccagaagagattgccaaccatgttttcagtaatgggatcagtgttagcattagggcaccacttacaaagatgagtactaattttgagggcaaggtgctgatttatctgcctaggttctggcacacatgtttaaagattcacctaattactttagagcaacgcccctcccaagtattatagagaagaaagaggagaatgatgtgctcaagaaaacaatgtggagaagtttatattggttgtttaaacatagtacctaaaaaaaaaaaaatggggaaaaacgatctgggaagtaaagaaagaatcaaggagcaaagatttagcaagcctgtggaccctgacaactccaataagagaacactagggaattttgtgatttaaaatatattattgcttaaaactacagtagtgttcaaggaaactttaaatagaaaattactcttcttgagatgattctgtcttccaaagagaacaaatcacaaggatgttaaaaggaacattttatgtgacaagtttggggtaggtactatgtaaatagaagagaaagtcactcaaggtacatttgaatgtagggcagagattattccatagcattccacaggccagaaacagaaagtgtcttctagttttcttgccctttatagtaataggggtcatgggatagaaattctcagaaaatctccaaatctcatttttgccaattgtttcaacatcttttccttcccagcattttagcagagctgccaaacaggtgattaattaaatacatatgtgcatgcttgtacctcgtgtagaaggtctaatgagtaaatttatttgatatgacatagactgaacagtagaaggaaggattaatgacagtcagatcaacaaacaaaagtacaaatggtatctgggctatgaaaagataaagcaatatttgcccaaacaagaagatctagatatccctaaattacctcctatattattaggaagtaaagaccaaatctacaactttgatctggaaattgtatagtagctgatatgaacagggatcataggagagtgtggtctcatagctactctttgctactaccaaaacctgagtggtagcacatcagtgattgcccaaccaaactgcacaattcccattagaaaaagctgtctcaaacccacatcttagaaaggaagtgaatgccaccagtgaatcaatacactgggatgtaactttctgcataccccaagaatacctcctgttgcatagcactttttagttttcaaagcttttcagatgtaacagatgtgacagctgttgtttttagtgtgccacagctcatctcacttaattctttagggtaagtgaaaaagatgagtgtaattagtatcaaataagagaagaagaattgaaggttcagggactagagaccacacatatatgtggttagaaagtccaaagtaagaacagtagagctagtttgtattggacacttactatgcaccaggaaccattcccaatcccatacatgcattagctcatgcatgtcatcctccaaaacagcctcgggaggtggatctagcattacctttatcttacaaatgaggaaaccaggcagagcaagtttaagaaacctgcacaggtgtgaattctggaagtctgtgttagaaccaggactcctggtccctctcccacctccagcttcctcaccagatcctattatcagcacacaaggaaaaaaattccataatgagaggtattgttctaacagatgtactatcttcctctacttaactctgaatttttctctgaagacagaacaccacgtaatttgttatagaatagggcttagtaatcagttaaaatataaacttgttaaataatatctaaactgtcctctaacctaattgatgttggtttaaagaaatgctaagcaaaagcatcaaaatagaggtatttttatattaaaaagaagaaaaaggaaaatgaatccgttattttatattgtctgcttctgccccctcctggcttttgcttcatgggcttccatctggctcatttcatctggccaaaaacattggtcatgtggttgtattttactgccaaatattactccttggccagctgttcagaggagccagaagattctctgagctcgagaggtcaactccatcctgtgtcatgtctatttattctactggcatagtcttgactattaaactaggtttcttaatgatatttcaaattgtgagtaatgttggctaaattgacaaaaagaaattatagacaacatttatatctaagaataacaatactactaacaaccattgcacattgtaggaagaggtagcatggtataggaggagaactttggctctagagccaaacagacccagcttcagtgccaactctgctgctttcttgattgggcaggtttcctaacctctctgagccatttccatgtacataaatagaaaattaaaatatctacttcataaggtcgttgtgcagattagatgaaagcatgtacgtgaatgcaggactacctgccaactctttcatagcattttccaagtcttcactaacatttcacaaattttgtgaagcttcttttgtgaaatacattttcagataaactatcatcattggtaccactcttggtcacagaatagtacaatagagctggcttataaatggttaccttataagcaacttgcacatacaacccaggctcaccttggaaatgtagtgtgcaggaatgattgacagctggctagctctacagccacactgctgctgaggttcacattttcacattatcacttatagctatgagactttgggcaagttacttcatgtgcctcagtttcctcatttgtaaaatggagtattatgaggattaagtgtgttagccatgtaaagtgcctggcacatagacaacactaaaataaatgtcagctattattaataatagaatgtaagctccacatggcagcaatttttgtccttttttccacctttgtatggccagtgcctggaagagtgtgtggtacatattaggtgcttggcgtttgtgtattgaatgaatgaacctattagcaaatgtgttccgattcatggcaagtgtgaggatactctgcttccttttgccacattcatgggaagagggggttagagctgaaggaacctgatggttcatttgttcaaactcatttgtcttacattgaagagcttgaagaccttgaaaggccccagggtcatgcaacttgatagcggcctggtcagagctagaaccctggctctgtgtgcttctgtgaaaatctttgttccaatgtcccacccctcacttcaatacatatgccatctaattcagtgctttcagtaaggcagcaaaatgaatgaatgattcagagcacacttcttgcagacaggagagtgtataagagccataattgggcaatgaccatggaaggacaggtttctgaataagagaaagacttatccaagtaaaattatgttcagacattttacttacaagtctaaaaatcacttgctacaacagctacaatagggtttttgtaaggaagtaccactttgtaaacaacatttttgtagaatgcattatatgcatttttttcaaaattgaaggaaagccccatctcaaacattcaaaagaatctgctcaattatcaatgtagactagaaacagagatagagaggggagatacagtttgagtgttttctgtattatcatgacagcacatggaacaaccacaggcagaaagattacaaactctgcaataaatataaaggtattggttttataaggtggcctgcaggctacggaccagcacagagctctggcaaatgtggaatgccaggagatgtacaaaaaaatcaaggtgacaaaagaagaaaagacactccaaactgccaagggtttataatcatgctgtggatatttctgatcatcagtgtgttaatggttttcactatagttaaaactataccatttttgaatgggtaataggtatgaatatttatgcttaattagtagtttataaaatttatactatttattttcataatgttgattttatgattttcaacgagtgccatttgtccttaagtcatgaagtggatgagcccccatcaagtgattttaagagacagtaccttgactgagcagctggatcaaagcctgtctgatctgggcagagcaaataaggaatacttcttacaaaagaggaagcattcaattctatacactttaccttggtactccttgttctggaggcctcagcttctatcatgttctttgccacagtcatatacccaccttctaccttggctctccctcctcctaacttccattattttttctactttcaaactataattgacaagcctttttaatttcaacaagggtctgaagagaggtgtctgattttccgtaaggctgggttatataagcacacagagttgaatcagagcaaaggaaaaatccattggcaaaggaagaatactatatgctactttaaaacttgtctgaatgtattattttatttacttattttagaggcagggtctcactctgtcatctaggctggagtacagtggcatgatcatcactcattgcagcctcaaactcctaggctcaagggatcctccagccacagcctcctgggtagctaggactacaggtgcaccctaccattcctggcttaaaaaatatatattttagagtctgttttgcccgggtttgtctcaaatacttggcctcaagttatcctcccacctcagcctcctaaagtgctgggattacaggcatgagccatggcacatggctcaaattatataattcattagctggtaatagtgtaaatttggaagagaaaaactaaaatgataaagaggaaagatggattgtgaatagagtaaatatatattactgtaattatgttaagccaatcaaatgcaaaggacagttcaaaggggacaagtatgtaagccacattccaaaaaaaaaaaaaaagctttgaagtgaagctttaaaaagataagctttgtgttgagctaaagaaataaactctataaaaacaaaaccctaaaattgttatgacaatgaattaaacattcaaaaatgaacagaacagaatgtaaaagattattccttcaggtggtaaatgttcacaaccagctctctatgggggaggggaagggcactatttgtagtatttgctgatttctgtgccaaaaaattctctcacctgcccatttcaaacagcagaggtcactaaatgtggagttggcaagagatacatagacatagtactctatacagtgtttctatcatatagatacagtagatataagttgccccaaaaacataataatacaaaatgtagccaaatcattcagaagttatgagttttgaatacttatttccattgtttttaatataatttgtttaattatagttaaaaatttttatgtaatttaatttttaataactgttgggtattaacaactgacttataaatactcctaaaaatgtaacagaatgtagtgagggacaaaatggatgcggtctctgctttcatcaagtttacattctggtagagaaagacagaaaataaacaagttaacaataaataaaataaatagagactgagatgagaggttctgcttggggaagccagggaaacctttacaaagaaattgataatttatttgcatataagttcaagcatatccattccatacatctgtgagtacatttgtagttctaggcctgaaactcagaactgcacaaggtcaatggaaccatataaatattgacctcattactgacttgttttcagtctccagtctcttgagtgaatttacctttgcttctttgttattataaaaatacagtgagggaaagtaaaacaaggaggaagatgaaaagaagatgtagggggaagaggagcagtttacaatatactttctattacattgtttcacactatctcaaaactttttatacgtagaaaatactaaagcaaagaaaaatggaagttaaaaatcggtagcagtagtaatagtcctatagtaggaaccttgttttgtttgaaatatgtgtctgtgtctgcctacaaaacataaacaccttaagctaagaataactgtgagattaattttttattttcaaagaaataatacaaattttaaatcttgcattaaaaggaaagctagctggacgaaacttttctgacacacagattttgagaatagcacccataaatatgcttccaatgcttgtcacttgatccctttttggcaattaacttgcctttaattgatttgtggattacccactggaagttgctatggataaaggaatgtaatggcagagtttgtttatatagggtaacaaaatagactggctgggaggagggatttaactgcaaaatatccttgattttcaggaatttttcttttcacataatggcagtgtttagataaagaatggaaagttaatgaatcagatttgtgttcccatccaaagggaagatttatgtcctgtttaagaatcacattaatttgatgacgttagtacattctctagtgaaagagtggccactttagtggaggaaaaaaacaagcaacaaaactccttctgccatcttcaggttgtacctgacgaaaagcttttatttgtgggttctatgaagtatcactgccctgatctcagatgaactaaaagatgaaaacatttcatcgctcaaataattgtttatctcacatcttactggttctagaaaaggactatatattttccctcctaactttcctcagtttcttggtataaagttcaaaatgctttgagtagagttgttcaggaggtcctcagtggcactgccactcactggttgggacgtttttgttctctgtcctcctgtgtggaagatgacaaggacggctttgtgcaacttctgttgtatgcgctgcttttcaaccccttggatgagatactcatacaaggaacgtcaggtttttttcctaaagcaaatccgtgtaaactgagacaacataaaccttagggagatctgacacaccaaaatgccaagaaagggaaagaagaaattattatcggtgggggaaacaaattatcctgtattttggagtgaatttaaaaggcttattgtttgttttagcactacatgacttaaaaaaaaaagtctcgcagtcttgccttcctcatgttggttaaaatggaaaggattctctttctttgctatttatagataacccttagcactctgcaaggatctatttggtataaaatgatgggtgtgaatgtgccagtaagagagaaaaaaatgcttagccatatttactcatataaccaacatctaggtcaaaatcaaaatattaccagctcccaaggggacccctttattcttctttccagtcactatgcacccgaagataaccactaactgacttccaatagcatagatttgactacttttgaattttatatgaatgaaattatacaatataaactcttattttatttcagtcaatattgtgtttatgggattcattcatagtgttttgtgcattctttattctcattttgttagtattgcaccaaatgaatatgctacaatttacttattctagtgttgatggatagttaagtattccagttttaggccattatgaattagagccattatgaacattattggatatatcacttagtaaacaaatgtacatgtagtgttgcagtgttttgtgcatacacgtaggttgggtatatcccaagaggtaggatttctgggtcataggttatgcctttgtctttagatattgccaaatgtgtttctatactggttgccacatttatgtcgcccccaaagtgatgtttcagttctctgcattcttaccaaagtataggtcatccattttcagtgatggcatcttaaaaaatgtttgcctgtaataacaatgtcatcatgccttttatttatgcagttgagtcttttaatctttaggacctgtttttccaggaatagtgtgggtaacagtgagccattcacactctgtctgtttctcctcatgatgaatactatgtaactgtgaattaagtgactaaaataagaaacgatctgatatgcagaaatagagttttccctgtttgatccatatgcagcttaaatatgtgatgttattctacattttatccagattcatttttcaaaccaatagtaatcattgttagcaaaaaccaataaataatcttttattctgttttaaaatttccatgtcgtactttgagttcttgctatatatcccgtgctcactttaaatcaggttttccttcccgtacattatttcttggaaaatatgttttggacttttcctaaaccaccttaacctgttgaaaaacactagtaaatgcataggcagtgtaagtcacgctaaaataaatgtgtattgctttttcaagattttgtttacccatgcatttaaagaaggtttttttccctttattttctttcttttttgtcattatagtcattatgtctttttaatgttaagattccggtaatatatattcctcatttttatgtcatctccaaagctccccataactgattgatgatatcaatccggcttctggcatataaagtttgttgacctggttcagtttgtaccatgtcaaaatgtgatcattaattattagatgatgtcaggaaaaatttagtatgtgtgataactgtgggtcccatttcttaaagctttcaaaatccaatcttaaggctctctactttgtggcatatgagggaacataagtaaacattagagcaatatcaaacgtattctaagggtttcatgatgtgaaacaatatatcactttattaccagacagatacttcacatcgtgaaatttgaaaaagcatacgaggtggggcacagtggtttaccctataatcctagtgctttgggagggtgaggtgggaggatcgcctgagtccaagagtttgacaccagcctgtgctacagagtgagaccccatttctacaaaaaatttaaaaattagtagggtgtgatggtgcctgcctgtagtctcagctactctgggggctgagggaggattgcttgagcctgggaggtcaaggctgcagtgaatgtgatcacaggagtgtactccagcctgggcaacagagtgagacctcatctctgaaaaaaagaaaaagtatgtaatttttacgtaagagtcactcgattcatatcatgaagcttgtgctaaaaatggaatcattcagtgatcatgggctgcttttcaagcatttttcgctcaccctttaccattatgacagtaaactttggggaaaggggaaggcatgggccaatacatcttttagtatttcttggttatactaagaactactgaggaactgctaaggaacaactacatagataaaaagtatttttattataacccttgtgaaaaacctcttcccccataaaacgtttagtatcttgtatgaaggcataatgtacttttaaatattcaaatccaattccagatttcatttatgtgctatgtactgtgtaatccaccacgcaaaatgtaatttcttgcttttaatataaattttcattattatcataaatgaagtctcagaccacaacattttgttaggttgcattcaaatggtaatcataatatgacctataccagtttttgcatggaagggcagcagccggctgaactagatttccacttttgtcttggctcattaaacaacaatggacaagttaccttaacttcatgggtcctcaaccttctcattcgaaattgagtgtatggactgtatattacaatatccttttaagcttacagaaataacattatggaggtatgagaaaattgtaaatgatccaagatatgtgcctaaatatttcttcatacatcaagcatgcattcatgaaatcaacaccaagcccaggaaatatcaaagaatagctcaatgtccctgtgaacttatatccaattcaataattcatccaacaaatgtatattgagtatataatctgctagacttatgaagccttaaactttatgctgtacattctgatatatgttgttttaaccaggggttggtcagctttcaaaagtgacccttttgctaacattgttcttctggctgaaagctagtaagtataagcaaaaggagagatgtatatgatctcacttctatgtggaatctaaaaaagtcaaactcacagaggcagataatagaagggggttaccagggggtgatgggaacaggagggattggggaaatggtggtcagaggatataaaatttcagttagacaagaggaataagttcaagagatctactgtacaacatggtgactatcattaagaacaatgtattgtaaaccaaatattatatgtggtcacttataagtgtgacctaaataatgagaccacatggatacataggggggaacaacagacacaggagcataccagagaggggagggtgggagaagggagagaatcaggaaaaataactaatggatactaggcttaatacccccatgacacgaatttaccattgtaacaaacctgcacatatatccctgaactttaaataataacaaaaccaaaaaaaaaaaagaaaatttctaagagagtagattttaaatgttctcaccacaaaaaagtatgtgagttaatgcatatgttaattagcttgatttagctcttccgtaatgtgtacgtatttcagaacatcatcttgcgcactataaatgtatgcaatgtttgtcagttaaatatttttaaatgaattttttgaaaagaggaggggtgtgaaaatgaagactacttctgactttatattttatattctggggttacaagaatgagacctccctgatgcctacacacaaatggattaatgtgaaactgaaggtttacttgcccagtttacttgcccatgtttacttgcccagttgattcagctggtttatgtataattgtcaacaatttaaactctgtcccattcctccccaaaatttatgtactttaaaaatagatctcatcatttcaacatttcaatttatatatgagagaaataaaaaggactagtaaaaattatatgaagaagcaactccaaatatggtaatttatggttcaaaggagataggtaattgtcttctctcaagagccactagaccacaaaatatcaacatcaaagatgaatgcaagcgctaggggaaacgatacagatcagaggcaccatgtgttgtgcattctggtatttgtcagagataaggaatgaagctgaattttttcatggatttgtcttgaaggaaaataaaatgagaggttatgctaagtataaaactatctttacaaagttcctttccgttaagaccttcaaagatatgtaaaatcataatttgagaattgcttttaaggacctaattcaggttagctaacaaatcattatctaaaaagagagtgttagaatactatgcatttaaagtgagtagttcacttcatgattgagcagaaattcctgagttcaaatcatggctcttccacttgcagcttgtatgacatttatgaaattccttaagtgtgctctgtttcaggtgcctctgcgcctacatcattagagttattcaagtattaaatgagataatacatatatagccgttaaactagcgcctggcatagagtaaacagtcagctcacatcagctagcgttattcacaagaataggctatacatttctttccatcaaagataagtgcaagtttgaatagaaaaattaatttatgaaacaagactgattttatgcttttctatagtgcccatgattcaaaggaaaagaaggaaataatcaccaaccaagtgaccctgtaaaatagataggagttacgccatgcatacatacatgcatatatatgtattttggatatatatggatatattatgtgtgtgtttgcatacgcattatatatacatacatacctttgccaagaaaattggatgtctcatatctaaaaaactttcagtgttaagaactagccaagtgtcaagtacacaatttgtattcaacatatatttacagaatttaactttgtaaaaatttcaaatcactgttattgcttttcctacttgtaaaacaattacaaaaatcccttggcttttgtggtgtggactattataagggactctgatgcttcatgacagggagtaatttgatccaaagtacaacggagctctcgtgtggatttaagttaccaaactattgaagggacccatgcaccaccaagtattcaaatcacaatataatttcattattctctaccctcccttgcaaatgtaataactctgaactgataaacacattgtacctgtgtagaaaaatgccacccagaaggaagctgactgctaatctaggcctgtgctgtccaacaagagagctagtagccatagagcacttgagctgtggctaatccaaatcagatgtgctggtaatgtaacatgcacaaaggatttcaaataatagtgtgaaaaaaagtaaaaattttctcatttgtaattttcataatgattacatgtttaaatactaatactgtgtatagggttaaataaaacatatttaaattaatttcacctggttgtatctaagtgtccatcagccaattaacggataaagaaaatatggtacatacacacaatggagtactattcagccacaaaaaggaatgagatcctgtcatctgcaacaatatggatggaactggaggtcattatattaagtgaaataagccacacacagaaagacaaactttgtatgttctcatttgtgggaggtaaaaatgaagacaattgatctcatggagatagagtggaaagatggttatcagaacctaggaagggtagtgagtggcaggggtgtgggagtggagatggttaatgggtacaaaaatatatttagatagaatgattaagatctagtatttgatagcacaaaagactgattgcagtcacaataatttattgtacattttttaattaaagagtataattggattgtttgtaacacaaaggataaattattgaggtgatggatacctcatttaccctgatgtgattattaggcattgtatgccttatatcaaaatatctcatgtaccccataaatatacctactatgtacccacaaaagtaaaaagtaaatacattaatttcacctggttgtaaaaataactttttgtaatatggctttttaaaaatttaaaattacatgttgtggccatcattcatggttcacattatgtttctactgaacagcgttgatctagacagtagacactacgcaaaaacagctaagaaaattattaattctttaaaaggataaaatttaaagtgataaatgagatcaaattttatgagcaagtccatcgtagttcactctgtgcttgtttctagggaaaaaaaattggaactttctgtagagtgtgccagtcaatgcaaaagtgctcatcaagagagaattaaaacattagcaaataggggctgttgatgaaaatgagattccagagagggtgagaagactgaacacattcctgtaaagcaacagggattaatgcaccaatgagaattgcttttttttttttaaacaaaacaaaacaaaacaacaaaaaaacccactaaatttttctaggggaaaagtaaatgctagagtgatattagtgaattaggggatttgtgaagatgcatttgaatgtcaagaatataatgtagttttcttagtatttttgaattcagtgaccttttgttaacctcaagagactgaggctaagacaccaacatttaccatgtgcttcaatcattctctcaaggacgcacagctcctctgagctgtaataggaattcaggtctgtgtgactcctgagcccacatgaccgaacgtgtgcccatggaacactggtccctgcaactgctctgcaaataatggttctatacttaaatcattttaagaaatgttgcatgtatcgttaccgtcttaaacatgattcattgatttgcatattaaaggcactgagaattgctaaaaaactgtttaactttttaaaatctttttctcaaacttcttttgccacagaacacctcctcccctgcacatgcatctatatgccatttatcaccagttgcatgctgaaactaaccttagacagaatgctatttggaaatgctgagatgccttaaattgccttctatcatctctcattattagttactaaggaaaatggctttgagaaaatataaaatatttcaggaaaatatgtaatttgatgctcagataactcactttttgctacatcagaaaaagcaaaactagaatttaaaaataaacttggatgcatgtcttggttattcttatattcatagtgtgtgatccaaagggagtcaaagaaatctgtagcgaggctgctcacagtctaggtctctttttgtgtaggacaaaggtagggcttggcttctagttgaagctacagttctgtaggacttgggatttggaaaagtaatgacaagataaataagttatcaccatcagagacctaaatggttgcaaatttggcactggttacataatgaacaaaagtttcataacatatttcataagatattttcataacatatgtcttacaattactttttttattttctgaggttttttctctaaattatgctaaaaatgtcatcgagaagcataaaaacagactttcattaatagttgctatagcagtgggaaatttttgtaggaatttaagtaaaaaagcaagttatttagcagttttgttcaaattagacatttctgccatcagcctgccccctgggaacttggaaagtgcatacttgctcttgagttctgctagtgccctaaccacacgcctttcatgtctaccatacttcgatgatcttggattcaaatatgatcctctgccttcctcacagaaagaaacaatttagggacatggacttaatggtaatgactttcaaaagctaatgacgtgcagtctttcggcactgcctagccgaacactctttagacaacctgctgctttagactggacatgcacatgattcctaagatacactaaacaagaatatgagatgctgagtccattgtttcctgtgcaaaattcagttcaccaagaatactattttcaccaagaaagccatagactgtgtgtaggtaaagaacttttgcgctaatgaaacttgttattggctgggactaggggcctaaatactagtttgagattctgtttctgctgtgccatatagcatgagatcccacttttgcctctataaagcagggctatggttatctttccttattacctcagttgattgttggctgtgagaaccaagtaagatatgcttcatggaataacagaagaatgcaagatattatcacgggaggcaacatttttgggatatcacatattagtggaaacttaaagaatatttgagaggttatctttgacatttacataaaaccatgtatgaaacaagtagttcttgtgtttttttaacctatgaactttttcaagtgttttctccacaacattcctctcttctaccaaagaaaatcagtttacagtcatgtgttttgtaaaagcctaaatgggaatgaaggtggttagtaagagggttcacaagatggagaggctcccatgacatttgtaggtttaatctcgtgccccatgacctcttaaaatgtccccatgcccattcagaataccccaattcacttcaaaggcaaaaacaacgtgacattgtgaaatcataccagatgttctagtagaactgtgttctggtcctattgagttcacccaggagaggcatcaaactctgcaatcagaacatatcaacacatggcctattagctgattctgccacttggtagctgtatattctctctctgtttagtgtccttatctgtaaattgaaataataataatagctcataaggctttgtggggattaagtgagataatcatgtacagtgcccagcacagtgtctactgcatggtaaatactgcaaaaatgttagctgttgactgctcctatttatgaccttcattattaaaaaggggaacttaggctgacgcaggagaatggcgtgaaccccgggggacggagcctgcagtgagccgagatcacaccactgccctccagcctgggcgacagcgagactccgtgtcaaaaaaaaaaaaaaggtgggggggggggaacttatgaatgcctttcacttataccagcatcattaaaaatttaagttttttaagaaccatgaaaagctaaccattgacaatttaagaagcatgcaagcttggtttacaaaagaactggacaagctcagaatgggctagttcagtggagtgactgctgcaggagctcaggttttgagaccttcctgtcttcttccttcatccttctcctctttttgtgttctctccacacacttttcctcatcaaagccaaaacctttgttcttgctatattctctttttagagcctgctcacagtaaaattttaaaaaaatgaagaagtgctgaaagtgtagataagcaattagacatgagttaatgttttttatttgcaagagcatttgcattctaatatgaactgaacattgagtaaatagattcctgactccctaacagggctatgtcttgtgtcaggaagccagcgcactgggcttcttggtaggcaggagacccaagtcatcatctgctactaaggctgggtcttggaagatggagaaggccgtagaagaaaggaaagccaaaaaaagaaaggaatgagattttgatatattaattagctcatactataagcctggacttttgctaggcattttccatggtaatttggttatacctcaaaacaattctcaacattattatcactgccaccacttctgttagcagctgtgagaacagaggtcatgtgagtaagcagtttgctaagggttgcatagcttaaaaagtagtcaataagctaaagtttgaaccctgagatgcctggccttcacagctaaacttttattaattacacctgcttctaacaacaacaaccatggctaaagtttcattaacctaccagtttctaacaacattaacaaaaacattttcaaaaatataataatagtcatcaataggaataaagggaaacaatccaaaaatagctctgttgaggttactgatggatggggacaggaaagtacaaaattttttctacgaaagtttccctttgaggatcactttccttggctgtcttgccttgtgaaattataccttccctaatggcttggagctgattgtgcccttctttctgtcaaggacagcttaaacttcatggaatagtttatttgaagcttgtgggtaccaattccaggcagcaagatactactttcagagattcaattaacttccttcagagtcacagcaaaaagcgatagagctaaattgattaccttgaagtgccttaaccgttttgctgctgttgttacttcttgagccaatttattctcccagcaatgtcactgttactgaagttggtctgttctttattctcagtttatgaataggaatcatctgaatatagttatagacctctagtctagatcattttttgcaaaattacaaagatgggaaaatttccaagccatagttattccaaatggctgggagtgccttaggaacttatttctggagtcttttgaactatttatattattgatatgaacaatgcccctgattgttagttagcaatctattcattgatagggacatgaaaggcagtctgctgccatctagctttttagtttctatctttaggaattttccggtcctttcacagaaagacactttttaaaggagcaattcttacttcatccctgagagggagacacttatgaaggtactgcagaatcttaaaaaaaaagtcttcatcattcttttacttctttttgcctttaagttggtcttaaatgggtaaaagtgataaatgtaggttgtgtagttcaaatccattgcagtgactaagcagtgaccacccataggggcaaaaactatgtatttttagaggcaaagattgataaccacagccatgaccctgagcaagactgtgaaatagatgcagttctttgccatcctcccttttcctgagttatgggcactttctgccttcatagctgtttcctctgcaaaatggagattttactgtcagaagtctcctattgctattgcttcttggagttggttcccatgctctgggcacaggaaagcaatctgagatcttcactactagtatttattgagcacctatactatgccaggactggactgtgctctgaggtcacagtggtaaacataccgacatggttcctgctgtcatgagccttccaaaggaatagcgaagaaaaacattaaacatatcagcccatgattaaatgcataattagataaaatgcattgaagaagtaaagatcccaggaaaggagagaaccaattaatatgatggatgggaaatcaaggctgctggaaggaagtagtgtataagctgaaaaatgaggagtgaataggaattagccaagtgaaaagcagaggcaaatgggtttcaggaaaaggaaaaacatatgtaccagtaacatttcaagaagaaatgggaaggattagatgatttctgttattcttattaggttgatctcttccatggaagagacacacagaatgtaattaatttatagaatataaaaatgatttttttttttaggaatggggaggtgaggagaagacccgcttcaagttctgttccaatattaatatggttttgctttctctacaaacctaagtaaaacaatggtggtaccaagggttggttgggaggcactagttttcccagtgtacatactcacaactaacataaaagctaaatacgtataatcaacatgcttacactacaaacacaacttcaaataaaattcactagatcaaccgggcacagtgcctcacacctgtaatcctagcactttgggaggctgaggcgggcagatcacctgaggtcaggagtttgagaccagcctgaccaaggtggtgaaaccccatctctataaaaatacaaaaattagccaggcataatggcaggttcctgtagtcccagctactagggaggctgaggcaggaaaattgcttgaactcaggaggcagaggttgcagtgagccaagatcatgccattgcactccagcctgggtgacagagctaggctccatctccaaaaaaaaaaaaaaaaaaaaaaaaaaaactccactggatcctctcttccaacttttttcccctaatttcttcccttagcactgatattatcaaacaagtggccaatcctataaaggctatcagactccaatttaaaaaaactattaaatttaaaaacactcagagatataatgattgtatgccttttatgaggaaacttagtacctaaaagaaaaccctataacttaacattaagcatatgaaggtagctattattcaaataagtagcagtaaagacttttcagctttggatcctcataaacaagacctgcaggtttaaagatttgcatacatcttttaacaatgcatcatttttattatagtatattatatactattttatatttacttaatgagattactgacctgggtttcaagatatgtatgaaatataattaggatatgaaaattaaagataaattatccccaccagaaataatcttagcaggttatttactaaagaatcttaaatccagcagatcaagaaaaactccccaaggagtctttaattagaactctttaggatggaatcaaaatctctccataaaaaatgaatcttgccttaggctacataaattacaaaatctgaagccctttaagcagcattaaaactgctgattttaattgctctgataatgaactggagagagacacactaagcttcctggatttctgttggaaatgaatgggattcttgccaactatggatcacagttatgaggtattctgcacagggaaaatcaaaagaaagcagatggaccttgacatgctatgccatcctatgccttcttccttcccaagaagcatgttacaataactttaagtgaaggttgtcacaactttaagtgaaaagtctcccctttctgtctaatttttaatgtaacttcccccttctcgatatatccagaaaatagttaataacaatccctgagggaaaagaaaaatgctgcccttcatattaaaaaaaagaagataacagagatccccttagtggtgagtgatttatagtgaaaacagccaactcattctcttttgcctccttttgacctagagaactggattcgcggatttgtaactggattttgattatagagtatgttctatggctacaaaagagttttcctttgaggaaaactcaaactgccaacagatatgcttggtatatcagttttcaatgctttcaattgtaaataacagaaacctggactcacaatagcttgaacaaataggaattacttttaagtaggtggcaccggaggtgtttcagctgttgcatgatgttatcaccatttgcaaagaggcagcatctccacaattttcttggcctgttcctcttgatggcaaatggctactgcacgtccagatgatcatgtctgtgtcacagatagtgagagggaaggaggaaggatgagagaggatggccagctaaagttgtatctaccccacttataagaaacacaaagcccttccccagagcttacagccctttagccagaactatgacacatggtcatcttgagtgcagaaagatggaagttaacatttggttttctggtctttttaataaagatagcaaggatgaagaagtttggaaaagactgtgggctagccaatcaaattgtcgaccacatttggcctgtattaatgtatagtttttaaagcctaatgtcaatttgttaaggtgtcttaaggacaggaaaatggagaagaactaagattttttatatcaaatacagagtaaatcttggaaagggtgaattagagtggaaaataaactagacattatctaagagtgccttgaagccagatcttgcaaaacattaggcaagcatgtcactcataatggaccccagggctttccatctcataatgtggataaaaataacagtgtttctctcagtttttaaaaatgtcaccaaaaattcaataaagtatatacatacatattgtaattgtttaaagtaaaaattttatgctgttttgggaagaaaaataaccaaaaaaaaccatcactgaccattggtcatcaaaatctgatttatgccatgtttacaagataaaaacaagaataaataataattgtttgaaatattttcatcatattgcctctgaaatgattgatgtcatactgcctggatttagtcaactcagtgaatgatttatcagtagccatgctctaaggagctctctattcatagatacttatgatttggtgaactgggaaacccacagagaaaggtaaatgaaataggagagccaggtaaatgggccatggatctaagaaccaggaatcatgattgtttggaagaacatatctcagactgagaaaagctggcgctaaagtaagctagcatttgattagaatgttgaaggataatttcattcttggagacagaaaacctaagtagaagcaaaagaagtaggaaatagaagcctgtgtttgagagattcagagtgactgtgttttattagaattgcaagaaagggaacttgaaaacataaatttaacatggggcaacaggccttggattctgaacagagggactttgtttaaggatggctctgtggctgtggaacagtttttctatagattatcaaaatgattctggaaaagaaatgtcattctggactgagagcacataccatagggaaaacatgaggcttatgggctgaattgtgtcacacccaaagtcatatgctgaagtcctaacctaggacctcagaatgtggctttatttgaagattgagcctgtaaataggtgattttgataaaatgagatcattagggtagacccgaatccaacaaggctggtgtctttataagaaaaggagattaagatgcacgcgcacacgcagagaagactacgtggagatgaggagaagatggccatctacaagccaagaggagaggtctcccgaagaaaccaaccccactgacatcttgacctcagtcctctggcctccggaactgttttaaaacataagtttctattgttaaagccacctaagtctgtggtattttgtaatggcagccctagggaaaaactacaatgagcaagtattatttgtattttaagaaataatattataaactaaattcatggaggggaaaatagaaaaagaggtcatttctgaaaacattgtataggtgtaacatagttgacactatcaactactacaatgggatcaggagacagagggtcagtgataacggagctctcaagactggaaactgggcgatccagaaggacaggcggttgatgaaagaaaatgatgagtgtggttgaggctgcgtttcccttgaggaggtgctggtgctcagggtagaggcatccatcacgatgtcagaaatgtgtgtcagacacgaaggcaggaatgaggctgtcgaggaagccatggcaacataaacagagaagtgccacagcgagacaaccagccaatgagttgtgtagtttcttgtaagtagctgaaacaacataaccaaattgttcaatttagtctacatatgaaatttcaatgtcagagaaaggcctttaatctcaaaacgaaataaactaaaagacattattttcctgacagctaagtcttaaaatttcttttgagaaataaaaaaaatggttttctcttttaacatagaggcaaaccagtaagtcagatacttcaggggaaggtagcttggtgatttgaatgtatgtgagtgtgaatacgtgagattagaatcttacctgagaacaaattttcatgagcatcattggagagtgggagagcatgaagacttttacccttctctctgcaggagagaattgtgcaggaggaggtggggagaatgccaccaagaacaggttgcctggggctagtttagcgatggggtccaaacgatctcactaatgtgaaaggatcatagttaccttaccaagggaaagttggcttcaactatatatttcacttctgtaccaggttttgcttaaatgctactctttggagaatatcaagaaatttagatgagtttaccaaatccaagattgtgttccctgcttttaactcttgttactgaaatagccccctgatccccaagagtaatgcttgactgaggtgtttgcatgaattgtttatatcattcattaattaacgtgatgaacatattaaagataggactcccagttttcatcccaagggcttacatataatagtaacaacctttagaaaagtactgcattgtttatttatagaatggctttgactcacttaataatgctccataattaatttgtaaattactttttgactttgcacaattataatttaatgtcatatatctgcaaaagaaaacacttttatgttgctaatattaatttcccttcataaatttgagactgttttgactatagataaatgtaaaatgtcaatgtggtgagaatgactcagcttctcagatattcatttattctataaatatttttgaatacctactatgtttcaggcactgatctaagtgttgaataagtagacaaggacagcctgccttcaggttttttacattcaaataacacaagatgatgaagaaatttttaaaataatctggttccatttggcagataatatagatatgctcagttttataaattttgatacctaaagtattgtgataatccaaatcatgacctttagacattacactatgcttattgattgaaggttgacatatgtttagcatattctcttataatgtatttaaggacttcagtgagtagacaaaagaagtaaacttgatcagacaacatgatttctgagaacagactcttcctggagcaagcattctggttagattttacagggcttcaataaaaaggtatatgtttatgctttttgctagttgggggtttcctagcaaatgattccatgaaaacatttgcagggaattcccatctgttctatatttccctgatttgggggctctgaatcaataatgctgatgtaacagttggcaaattagataagaacagcccgagacttccttttccattaggtgtagtctcatggaaaatcacccttgaatccatcaatggaatgaagcaactgggtggagcctatgggaaaatcctggaggaagtccccaactagtcagcctcccctctctgccttgcactcttggattccttagcgaaacatccaaaatggccttcttgcaaggaggatgcagtcggtgatccacatactgaccaacagctgtgtgtgaaaggcaccgtgcccaccacaacaaaggggcagtgaggtctgctgagcagatgagtcgcttttctggacccttccaggcttgcagttggctcagatgaaaagctcaggcttatgagctgccagaaagtatttggcaaaaagcccaccttttttctcaagtacacgtattcaattgacttgattcctcagagagatttgtgagggtgaaagcaagttcattgtccacttttaatgaccctcaacttctaatgaggtaatatatgtgaaagtgatttttttaaatgcaatgcaaatacagggtgtttttagtcattatttcagtacctgaggaaaatgtaaaaacacaaagccacacatgtaccaaggcactacatgagtgtacttggtttcaccatctaatttagccctctgaagtgtagagtccatcgaggctattattttgtggattgtgtactgaagttgcttttctttgttctcccaacatacacttgtgacacttccaacctctgatatgtatatgttaaatacaggctgtttttcaaacaagataaatcaaatgctagctaggaagtgtgcctagagtttaaagcattctagaatgtactcccatataacagctatacttatataatacctacattgtgccagtgtttcatatatgtgaagtgctttaatcctcacaacaaacataggagggatgtagtattattaccccctttttacagatgtgaaaactgcagtacacaaggtgaagtgagaggccccaaatcacacagctagtaaatggcagtgtcagacctcaaattccactagtctgtcttcagagtctatataattaaccactgctccctgtgcttttaaaggttagtttaatggatattgtgctatttctaataaaaggatataatttttgttatatatttttcttcttagtcttcacttttggatcttggaccacatgtgctattatcatattttagctcataagagacttctctgataattttgtataaaatacacttatagaacatttgtatcttgtaaatgtaatttttcttaccattatctcatttgatcccccttatccacctctagaatatacagagctttatcctcatttttcagacgaagaaatggaccaaagaagactaaacaatttgttcaactccatatcaccagtttgtagcagttctgtgactagaaaccaaatttcctggctcttagtcctacattctttctagtatttcaaatcatcttttcatttctctcccttatgcttttggaaagaaaattgagaagaacgttaagaaccccagtaaaattggagaggcatttcttgagaaatatttaaaataatttaagaagtcttcacaaaagtagtaggcaaaaatgtgttacattaacaacggatctcattaagtcagtgcatacagctaggttctggtttattaattttcaattttttcatttttgggcctgcctaatctgaacactttgcagtacaattctgagtgctctcatgctttgtgctatcgctttcttaaggtagctcatttgcacttgttcatcatcctgttccttcccccagtctcctgggctctgttgctaattattgacccaggaaagcctcagaaggggccaaggcagctaaaattggagtgctctttacttagacttataatgcattttccatttttcagaaagagtaaagcacttttagctaccagatccagagaccattcagttatatgggcacttgagtttctgctaaagaatcacaactcaatttaattttttttttttttggtatttcattcacagccagtctggagtgtgtgtgtgtgtgtgtgtgtgtgtgtgtgtgtgtgtatttctgtttctgtattaacatatgagacagcagaataataatgtgtccattcattccatagatatttctcaaagagttgccaagaataaagaatagtgctaaaaaaaggtggaagatggttaggtgtaaaattacctcctctcacaggacctggcacatgacaaatgcttcagaaatatttatcaaactgaaatgagctattacatgaattgtattctctggctttggaatctattggggaaatgatgaagtcattaaatatatgcgaattggaaaggaatttaggaatcatcttatgcagcccttttactttaaagatgaagcaatggaaatgcaagaaagttatgtgtcttttccaagcaagatcacacatctatttcgaaataatatgctttttttcattgtaacatgtgttttagagattacacatatgtcaatgtctgtagtgcagggcataatgtgaggagagctgttgaatgctttagaacagtgctacccagtggaaatataatgcacaccccatatacaattttagatttttattaatagccagatttttaaaagtttaaaagtcagtgaaattatttttttcatactaagtcttcaaaatccagagtgtgtattatatttttgacacatctcaatttggactagccatattttaagtatttaatagttatatgtgtcttggggggggctactctatagactatatggctccagaatcacagagagggaaaaataataatgtatttttaaagctgcagtatttttaccatgggttatatttttaagtttgattgtaacacaaaagtacaaaaatgaaacaaactgactcaacacattttttttcttttttttattattatactttaagttttagggtacatgtgcacaacgtgcaggtttgttacatatgtatacatgtgccatattggtgtgctgcacccattaactcgtcatctagcattaggtatatctcctaatgctatcccttccccctcctcccaccccacaacagtccccggtgtgtgatgttccccttcctgtgtccatgtgttctcattgttcaattcccacctatgagtgagaacatgcggtgtttggttttctgtccttgcgatagtttgctgagaatgatagtttccagcttcatccatgtccctacaaaggacatgaactcatcattttttatggctgcatagcattccatggtgtatatgtgccacattttcttaatctagtttatcattgtgactcaacacatttaaaaaaaaaatctagagtagacctatacaatttgacagattgcatcaatagttacaattttagacacccctacccctccacacatagaaattagtgaataagcagactgtcaatagtactggctcaaataattctacatacaagttctaccaaactttcaagggaggggtaacttctaccttatacgaattatctcattttacaagtaactataagtatacaataagttccatttgcagcactataggagcttgaactgtctgccaatttttaaagaatatgctcaagcaataatcttggttatccatattatcttacatttccttatgaatattgagagttctgttattgataaatacaaaggtgtcactgtttaatacactactgtgtaggtccttttgctatgcatttactatttaaagcgtaaaaacgtaggtagcaagaagatttatctttctggctattcttgaaattcctgtttctaacaagatattctgcagaagcaaagatactactgcattgttcaatgtttccacaaaaggttaatataattgtgggttcagctatcaccttgaccttttcttggatctttgatcagagtttaggtaaatatgttgttaggtttcccccttttaagttcctgagcttttgaagtaaaaccagagctgagataggaaagtgaacagcaaggggcagagcacagcagaaactgaattaggtcacttttctagaggcttctgaatttggtacagtaggatttctgtgatcatcttaaacctagcttttcaaaaggctattactgttccattttattctctggcccagaaaataaatcagaagacttctacatccttttcctcaaaagctgattctgattctctatatgatgccacattaataaagttttccctattaattaccatgatgccatgcagccttctaagatgttttctttagttcttagttcctttgcagttccatctccaagcataaattctcattaataatcagtacagtgaggaagatagacatgtgtcagtcagtgagaatgcttgcagctgtaactgccagaaagttgtaacttaactggcttaaaccaaagccatcctgaggtgggaggctccaagtcactcagtgacattatcaaaggcggcctgagtctttttcatctttctcttctgccagcctcaagtgttggtgagttttctggtttgttcctgtaaactcgagatgtctgtcacaggtccacctattacatgcagataactatggccagtcagaaaagaggatcttctttttacgtcttcttttaagaaagaaaaaaaatcatttccagatggtctccccttgtcccacttcccttcaatgtcttattggccaaaatggtttcacatgccgatgtcttaacaaatcactgccttggaaatcgtactttcatgattagctgagacaatcaggtttccctcatggtggctggggctgaggcccacctccctgtaagtatgtggctgcaagggtaggtggatatttgaatttcactgggggcctagtaggaaggaatggctcttgggtaggctacccatagagtcaactacaagtaaatcagaaactatagtatcataagtgctacagggaaacatgtaaatgcaggatgctgtaggaacacgcaagaagggcccctggccatgcttgcttgagcaagagggagagaggaatgccagagtgggcttttaatgaaaatgttatctgatctgagatataaagctcaagaggagatagccaaggaaagggtggtggaaggagagagagggtatcaggtagacacagtatcatgtgcaaatgactgggaataagataaaatgtggtaggtttggggagatgcagaaaaattagttggcctaaggtatagagcataagttggggagtcagtcagaaatagggctatagaggtaaactgtagatcataaaagatctgataagtcacatagaaatttctactttattctgctgcagtggggagccagtgaaatattttaagcagcaaatgacataattaaatatgcacttcaaaaaaaaaatgtctttggctgctgtgggaaattggattgcaaatcttcaagaccaaaagtaggtagaacatgtgagaatcaattacaatattccaggaaagagtggtgaagggctttaagataatgtcagtggggctggagagaggtgaataggtttgattgatgtttaggggttttgactaaacaggacttggttaataggtaagagaaatagggattaataatcactcacatttctggcttggacaactaggaggatgggaatgacatttactgagttaggatatccaaagaagaagcagactgggggcaaggggagtgaattaatttaaattgtaactaatgaagggcttattctgtatgaaattcaagagaagtattccagtccttaaagcattttcaaatgccaagggatatattaaccaataagtggtatagaacaatactaggggtactataatttatcacagatggtcatcaataaagcaagagagagagataaaagagcttaaagaagaaattgcctctctctcagaaagaattagtgggagaatctgatgttcttcatgaaagaaaaaaattttagttgaatcttgcataaaaagattagacagatgggaattgtcgagggtggaggcactgtacactacatgaagcatatttaaggaatgataacagtctagattgctagcaagcttgaataggcaaaataaaatagaaaggttagggattagttgaattagtcagaactgttgagattccaagagaaaaacaaaattcacattttctgtgttgatctattattgcaaggtgcattagtcagctattgctacagtaatgctaccgaacaatcaactacaaaataccaatgacatttgcttcttgctcatagtcctactaatgggtcagaatagtgctgcttcaggctgcaggttgccttcatgcttgttcttcatgtttctccttcttggaccagtgatctcccagggcgtgtccttgtggcacagtttacaactcccaatgtggcaagtagaaatgttcaatactttgtaaggcctcagtttataaagcagtatcatttgtgcccacattctgttagccacagcacataatgtgactaaacccaatatcactgagggaggagagcatgaggaagaaaaggatggtgaatatatgctgcaatgcctaaaacataatgtaaatatagatagcattggatttgacccataagccataaagattctagaataccagtgttcccaactatggagtgcccaatgagcttcttgacaaactcaggagagtaacctccatttgtgtgacctcctttctttgctctttatttgtgcttttcaaagggatgacatgagcccataaactactcattgggttgcttggtcagaatcagaaccagttacttcaggactgtctcatttcatgattagttgcctttggtctcatgcagtggtatcagttcattcctctagaggtttatgttccctcaatcaccagcaatactgagtgaatgataagaactaaagcaataaaaaatgattgaactattttccttagtatgtagttattggacttcttccaaaaatccagcacacttataaaaaccaaactaaggcattttgctggttattgtgccaatagtgtgtcttaattagtcctgagaatttatgtggcccatgaaagaggcataattttcctaagattgcacagctaagttacatatctgagacttgaagacatcctcagattatgttatccctaaatctctaattgctatgtagcaaaagattttagccatttttttattcctgaatcaaggatacataaataaagttgtattcaatcaatccaaaaatcctcaagcccaaataatcctagtacttgagcagaccttatagtgtgtgtgcacaagtgcgcatgcgtgtactctatttttagattatcttttaagagggaccggtgacatggtcatacagtacaacagaagaactcactccctgtttctctataattcccatattacactcagcacttgctctcctttcattctgtggcttctgtgctgctagcagtgaccagtgactcaggaaggctgcatatagtgaagaaaaagttgcctttccaggcacagttcagtcctgaggcgccttttcacaccatctcatagacatttcagagccaaactctagctttctttttatgactacttttccattccacacttttcttaatgttgcaggagataatttgaaagaaaggaaaaaagaacagggagaacacaaaggcaagaagatgagcaagatgccagatttaagaagtatatttatatttagttctttacaaattaaattctgctgagacccttaaatattagctgtcacaggggttgtgcttgaaaaacttgattccaaccctaagcataaaaatcttgtctaggcagggcagtagattggaggattatcattacacattataggaggaaggccctgttcaatgccaggttccaagaatgccatctcagggagcgagggaaagacataggccaggtaacatgtctgatgtatggagaaaagccctcagggtgccatgttggtggaacaggagcagaaaggaaatcagactgagagaatgaaaactcaatagaagcacaataaacagactgaacaaagtacagatggagtcagttcaagtttaatatgaatgtccctgggccctgtgtttcatcccagtgttaagtgcaggaaatcattggatttctccaaggatgggtctttagagcaaccgactttagaaattgaatactttaaaattattttctataaacaaatttatcaatagaaaaaatagattacttaattggtttatcttaatgagaaaacaacaaaaagcttcaacaaataattgttgctgattggttggtgggttcgttggtgaataatgagaaggaaagaaggaagaaaagaaaagaaggagtagaggaggaaaggaggtgagagagggagatttgaaagggaaatagcggtgctctaagttcacaatttttaaaagcctagagttattaacaaattatgccctcaatcagattttatataacttttttcaatcttgtcatatattaatgtgctgtattcatgaaatgattttgagattttaaagcaatgattgacaatatagtagttcatttaaagtttttacaagttgctgctgacaaaatatgggtaatgaattacatcaaataagtataaatataagtacacgctttgaagttaaaactcagtaagttgttatgattaaaattgttcactttattttcctcctgtgtatgggtttctcataaatggtaacttatacctatgaaaatacagggttctataaagtctgaaaacatagttattatatatcttaacggaccgaagatgtccttcctgatattatgtatagcctgtgtttccagactaagtgccaggcactattctaagttaggcacgattctaagtgttttactgttcatttaggctgtctggctagtgtttttctcaccttatcagcatcccatttttattaagtgaatttgcctaaacacacctgcacacgcacatgcatgcgcgtgcacacacacacactttttgcatttggaagcctggctattatggaactctagaacatgagagctcagggtcaaccaccaagactcaataaggtatggctggggatgtgaccaagactatcctagcatctatggctgtggactgggtgtcttctccactgacccttgaaggtagttttgcttcactgctttagaaatggtgcagagacttaatcttatttcacttttcggtgtttgtcttggttcctgtagaactggcttgaggcttagaagatgtcctcccacctgcatttggaaaaatacatttctaacacttctcctcatatggaaatttttaagtcattgaaaaactcatactgcagcatttgtagaaacaatttcagaacagagtaccttattgcttttcctaaaagaattttaactgtgcatgtataagtattataaatgcataaaatatatagttaatccaaaagacataactatatcatgcatagtagttataggtcacctcagatatattagtaacatctttttatagagactctgttgttatttcactcacacaaaagaataaacacagaattaaggttgaaatttacataagaccagtctaaagccagccatagctatgtaatttccatgattttctcccaatcaatggaaaattactgtcagctgagccaaagtctgcagactgtgagcaaatgtctgtttccttcccacaactgagtgtttgaaacttttttcaatcagtaaaattaccattaaaggtcagagattagtttttcatgcatgatggattccatttgctttaaaagtattataccaggagagtagactttttttctgactttagaatcaaattagaattcaaatattcagagttttgggtcaacctcaaactattttattttgtttattttcccttgacaaaatgttattgttttaaatagggaaggagaaaggtcttgggaaaacacacacacacacacacacacacacacacacacatatatatgtactctctcatatttgaaattagcatgtagtttaaggatactgcacacagctctatgatgagcttaacttgaatctccttagattatgagcattttgaaagcagggacttgattttttaactaaatacctttcatgtttgataacctgttccttttcctgtgtgtattgtcttaactaaagactgcctgcaatgaacagaagggctatggtcttttttttattaagataaaagaattttccaaatcgttgtttataaaataaaagattagaaaaattcacctgtgtataaattgaactagacttctataacatagcagccatcttgtgcagaaaggggctgcttacgtagtttatttctttaacacacagttgctaattacaaaaacagcatgcatccagagattgtgaaaaaagaagttaaaaaaaatcttgcctattattctaccaccgtaacacaattatgtttaacatttttcatatttttaatttattttctctttccataaattctaatctgtctataaatgtactattgtggtctgcttcgttgactaacagaatattttcacccctttcagaaccctttttttaaaaaatggcttcttttgtgtatttgaaacaatttcaacttaaccctattgcatatattctgtaagtagctgtccttcatgaaacagacaactttttcttttaaaaatcaaggagattgtacagaactttgtgattttaattactgcatggcaaactaattcagtctcatatcctttccatttaatagggatttgtccctagctatgtgacctaagcaagctctttaactgtactccacctcaatttgcttatctgtaaaacatggataatattatttttagtctaaaacttcctctggtatgacagaaaagaccaatgtgaaacaattccctgaatttgtcaataaaccatgttacatttataaaaatgcctccagtgtacccagaccagaggaatctgtggcttatactaaaacgtgtattatgtattcattctcaaggtatatgccaacagttaagttagaaatccatccctttctctgtcacttgtccaaagtcaattactccatgcttcttttacataaggaaaactatcttaaaaggaggaagtaagatcacggacaaacaaaagttcataaggtctttcattttactgcctttcaaaaggttaagatcagagaacttagacatgcataagctttggtttgaggaacaattgagtcaaccatcgtaacagagggcctgaaagtatctgaaggtagaatgaatagtttatagtaagccagtccactctcagctctgagaacatccagctgcataacctcaagggaactgcgtggaaaaaattaagggaaattctttgggctttagagcttttcatttcctatgaacaaggcatctcctgcccttgtctcacccatatctccattgtcctcatgtagtcttctgctggttcactgtgtgcctggcaagtcaggttcttacgcgagggaaagagctgttttaagttgtttatgaatagagaaagcagattcagtcagacgtaatctgactctgtatgcctgcaggggttgtggcctttgttagtttattatgcctgtaatttgggaagtcatgctgcagagatgtaaagtgggatgggcctgaaataggtcttgtaataaaaaggcagttagggaagcctgctggtgtcctgcctggttactactatctaagtgcagcaatgtgttagttgattttaataaagagttgaaatcattgttaactggcctccctcccactgagtgaagaaggcagattacacaggcacacgtttgcctcccctagtgtgtactatgaatgcagctgcttctgaagggccagcacgtggccttcttaaaactttccttggctggggttttcccttcttgccaactggtgcccaccaagccagtggatgctctcaacgtctaggcaaatgccaaaaatgtcatctttggctcagatgtgcactggcctgttagagacaactgccatgcagagaaggaatgtcatcagctgctaggtctcaaattatcagcctggattgacagctgcaggatgtagtgcctgcctatagtactgaggccatgacccacctctggagagaccacagcctcatccctagagtagaactggaaattctccattgagacaggaaggcagcacttgaacctggcaggttttggagtgaagtgtctaaggacagaatttctcatttctccacctctgcccatgtgtaaggcagcaatattttcatagaggtgaagaaggcaggtgtcccgtggttattatgacatctgtttacctcattctagtcactgtgccatgtttcacagccattgtcaactacatttggtgaaaactgtttcctccgtccacaactggaacattgacactaaccacattctagagttcattacatagagctgtgtctgtgggtaagttaacaggtagttttaaataactagatatagtcttttcctcttccatgtaagccaagataatatttccacttctccttctgaacatgtgagtacagtttatatataaatcaacagcaagatggaaatttactctgagctttgtgatgttttcactttaagatgctgtagttctgatcctttatacatttatttcattttccccatctcaaccccagtatatagcaacactcacctgctctagaacatgattatcaactgtttcagctatcaatgtaacattaaaaaaaaagttctatgttcaaagactaaaggaacccaggtagtttcttttaaacagaaagactagttttcatgatcataaacatgtaaagaaatatgtcatttttgaaatttcatgaatcttatgtctataccgattccaattccaaactcagactggcaatctgcctttattattgcaaagccccatagcttgttatcttcatgtacctcttgatcaagtatttaagtgaaataaagagtctaaatgttacgggaggtgagtccaggcagggtctacggccctcagtttttgtcttcctggaagaaaaaaattcagctgagagacagatgtagatttcagacagaagcaaaagtttattgaagcaaagtacatttggaagggaccaagtgggcaactggaaagattgagtgtcccgcctgattattggctcaggactcttataaagttactatttcctgattcttcctgatctcctcccatcatacttccttttgggccagctgttggctaatcgccgcgtgctcagtgacttgccagtaatctgggaggggctgcatgcgccatttggtggttgtagttatgcacatgtactctttgggcaattttcctttactggtctagtgcccccagaggaaggtcatataccagtcaaactttgccattttgccccttactgtgcatgcctgctcaattcctagggttttatcgcaaagttgttgcctacaagcttaagatgtttcctgttaggaaatttccccctccctggtgccagccatgaccatctatcattcctgaagaggccacctgacagtcacaatgacagtcatttgactgtctcctgacattccttggggccctatcctgccctgctcatatccacctatctacctaccctaacatattcccccctcaagagtgtgagactcaattatttggggctagtggatgaaggtcagtcctctgtggctgcttcctgctgaaataagggctgtatttgtcctctgggtctcaatctcttgctaattgtcagaacagaatggtcccatcggtaggtagaattggtgtccagccaggtccaggggaaacaggtgtatgttttcttcacatttgggtagggaggtagatattcctgtattgcagaatttctgctcctcagttcagctaaatccaggttctgtgtcacgaccaggaaaagttaggcatgcagacacgtggaagggtgaggggaatggaatttattatttattgggcgaaaaggaaaacaagaaaagaaaaactttcagcaaagtgagaggggtttctgccagcaggctcccatctcacagattggattccaagcccccacacacgagctaaagttcccaggctctttccccccaacaaggcatgaacttcctggtagctttaccccatcgtcgcagtgcacaggcgggcgggagattctccagggatcctccctcttatctgcctcctgcatctatcacctgcattattgggaacttggtttgaaattgttatatcctggagaagacaaatttatctagtaggttaaaaggcaggggccaaaaagaagtagacgtatggagacagctggttcgagcaggggaggaaccatgtgagcaatgggagagcagattttacagagttccagatggaatctgctgagggattttctttcccagagtcatgaagccacttagcgtggtcacagattctctttatatgttcctctacttgcccactattgttgacacaagtgcaatagggtttattgatgacagcacagacgactctgttctgcaaggaggtaatctagagctagtctgttgtccatgactgcattagctactgaattcagtgaagccttgagtttagagattctgttcccagttctctgacctaggtctccaatttgtgtagagaggttttggagggtgactttatgataactgaatcctctgtatggggcagctaatcctatggcagcccctagccctaccattataaggccaagagctctccttttttaagaatttgtaatgttatagatggttacacctgttccttgtggccccaggagtcctagggcacatcccctgtatgttgggtgttatctatgcagataaaaaggtttacaagtgagggggttgaataagttcttttagaacttccctcacagggcagtttattttgtttaggtccatataaaaatacatagcctggaggggtgtaggcccactcgggaatgttggttttgaaccaagtgtaagcataagcaatcccaccatgaataagatccagagtactggggctaccttatgctgagctagcattagtttgaaagaaaagaaggcattacttataatttcattgaaagagatattatagatcttccaatgactcacaggaatactcaggtgctggtcctattgttgattgttcagaagcctctcaaggttttatttaggaatgatgtatccaactagaggtgccaggaactttgatagctgttgcagtggaaaggaaaacagtaaaagggcctttccatgaggggattagttgagattttgtagatccatcactttaggttttaataaggacctgggtgggtacacaagttggttgttagagggtctggagccagcagtactctctgtatatatatttggttctaggtatgaaattctctgtcttggatttggatactttgtaccttacattttgctaggaaggttaaggtttgtactgcatattgttgtgcaagctttatggagggggagcagatgagtaagccatctacatacagcagaagttgtccccactcaagatatagcttggttagatttctttgctgggtcttgtccaaataagtgtggggcatctctaaaaccctgaggtaggactgctggctttcctgggagaaactgggatattagggggaaatatcagtccagatgttgggtaaatattaagtggatacccattttggaaagtatattcctactcaaaagcagtgtgaggcatttagacattgccagggactagtgggagaatagtaattagtcccataagcaatataaataaaggggatgtgaatctttagaggaaggggttgctacttgctcctgttacccaacagaatttgggggtaagttgcctagagaaaaaggttagcacaaagtaggcagttcttgtatttaaaaggatatttatagcactacctgtcatttccagagtttcccttggctctgttcctttaatgatgatgtctgatttggaagctggccagagtggagggccccttcagctcaaggccattattggatgggggttcaactgggggaccttttggatcccagggcagtccctcttccagtgggacttatctccagcttatcacaaagagggcaggctgtgtggggcttcctcccatttggcccatttggaaaattccttctccagtagcctggtcttctgcatcagtggcagttacctggaggagggtccttaggagaccctggagggggctggtgggcttgtaaagcagccaatagttgagcctgcatcttgtccctgcatttctccttttccttagccctgtcctccttgtccagatctcagttataaaagactgaggaggctaatttgaggatttgtggcataggggcactgggttctaaggctgacttttgtaaattttcctaatgtctggagcagcttgggtaaattgtcctttaggactagtccctcaggagattctgggtttaagtttggtgtgcttaataagtttcctgtagacttttcagaaaggctataggatttccatttggcccctggtttatggtggctaattattgtagtttagaggcttgatcttacttcattttattacctctattagacacaagagcctatggttcctggcccatattcccgctttggcattgtagtcctgattggggtccagctggggaacagctgtagcccctccagggtagttggcattttccaggtgtaagtcatttcgacagtggattgctgctccgcagatggtctgtctttcctcttgtaaaagggcttgtcccaggagtacatttatgtccttccaaattaatctaaatgtaagagccaatttggggaagccctctatgagccttttggggtcatctgagaacttttttaggtttttcctaagttgtcaaaagtcgtacatggaaaaggggatctggacctggacgagttcagttggctcacttacctcctacaagcttggagaggagaactaaggagcccggtgtaaagtggggccaattccaaaggtctgggagtgggataaatagggggaggatccaggggtggctgtttctccctctttcacctccaaaggaggaggtagtttttccttttggcttctggaggaagaaatgttggagaggaatcagcagaggagtctccagggccgatgcagggccctggaggagatggctaagcatagctaggatgtgaggtttgccttacaagctttacgaggattagggtcttccctttaggccataaaggtttgtaaataggggacctctggctttttgccctgataatggcagaaaaggtctagccggagaatggtattaaaatttgtacttccattctctagccagacttcctctgcaatgaaaaattagttttttcattttagggtttggtggttggatttatcgcagattttaaggatgcatccaaggggtcagtcccagagtatggagacaccgttatctatctgcaagacagaacagggaagagtaaggaagaggaaagagtcccttcttcttcatcttttttctttttctgtttttttttttttttttttttttttttgagacagagtctctctctgttgctcagctggagtgcagtggtgcaatctcagctcattgcaacctctacttcctgggttcaagtgatgcttgtgcctcagccttccgaggagctgggactacagatgcataccaccaagcccagctaatttttgtatttttagtagagacggggttttgtcctgaactcaggtgatccacccgccttggcctcataaagtgctggaattataagcatgagccaccacgcccagctgaaagcattccttcctgatccccttataccttggatcagagtagtgagtagggcatcccccattcatcctggagttctggaataaaccagtgattaccaggtaccactaaccctggtcccacatttccctccaggaccagccttcatctctctgctaatggtaatctgtcctgcacctgtggcctctggctgacctgtacctttgacactgtgatcttacagtgacctttgtttggagcattccagcaatgaaatggttttcctttctctcaaattcccattctccatatccctttaggtaggtgaggatcttatccctagccagcagctgtaagggaactgggccttcctttctctggacatagcactgtaggtcccagtatatgttaagaatgtagatggtcagaggaacagaggaaaacctgcatctgagtccccttgtcatccctcctgtggattcctggggaagcatggaaaacaagtatttaaaatgacaggacaatccatctgccacccgtgggaatggtagaaaataagggatattcatggaaggctgcttttgtacagtctcacaaacagcagcccttagacctaagaggacattgcctatcagtcttctcagtgtagaggaagaactgtcagggccagggagtttgggatgagagaccacaaaaggcagagaaagaattgtcctctccccaaagtgcagatagctctagaaaggaagtaggagttgctcttaatggaccacatacagatgccctatggagacaaacaaatgacctcaagagccactggaaaacctggtctcaatgtgtagcaggatttaaaaattcatgataggaaataaagaattggtggagacagagtcttcccaatattaagcagagaaagaagttgcatgatatgcagaatagaagcagggaagaggttgacttgcccccaagacagacagtgtggccagcatataaggccatctcaaagtccacagaaaaaaaggaagcataatagggtgtagacttattggggaaaagtccactttggttaaggaaatgaaggtctccagtctttgaatggcctaggctcaagccctatcacccttgtgagccacctgtccaaaagggccacagtgacttaggtctactcagtacagactctgaagtcctccacctctgctgtcgcccaccaggatgaactgaggaatctgctagagggaagagtgaccaaagagaatttttctggagatgggctggtgagtgagacagcaagagaaagaagacctcacgtaagcagagttgggtgcctccagccaaagatggcaaggcacagagggtcttaccgagaagctgcaatctgattcatgacaccaaaatgttactggcagcgggtttgggcaggatacacagtctttggttcttattgtctgagaagaaaaaatacatccaagagacagaagtagatttaagatggcagacaggaggcaggactagattgcagctctggacagagcagcatgtggaggctcgcattgtgaattatagctccagattgactgcaagaacaaaccagcaaccttgagaggacccacacaccctctgaaggaagcagactgctcttgcaggacctgggaaacaccccaaatactgtgagtaccccaactgtggaagtgggaaagggagaccctcctctcctgaacacacacccccactggagaagctgaaggtctgtttgcaagagaagtttctgactttacctggagctgagtcaatgtggagagctgagtgaaatacagaggcaaagaaagtagcagaaaggccctggaagctctctgagtcccctagcaggccatccatgcctggcatcacagggatccatccagagggcagccagagccagaggtgcaaggggtaaaactctacagggagaagaaaatctctagctgaagtttgtaacaatttgaatggggtgagaagcctcctggccagaactcaggggagggcacacatctggcgtgcagactccacaggtggagtagaaccaatccctttcattcacagctgggaggtgggtagcctggggcagattttcaagctcatcttgccctccaactgaaaatggactcaggctgttagagggtgggagacacagtgagagtgagactagccatttggtttgggtttgcgtggaagcagagtgaggcctgtgactgctggctttcccccacttccctgacaacctgcatgactcagcagaggaagccataatcctcctaggtgcacaactccagtgacctgggaatctcacccccatcccccatagcagccctagcaagactcacccaaggagagtctgagctcagacacacctagccttgcccccacctgatggtccttccctatctaccctgggagtggaagacaaagggcatataatcttgggagttctagggttcctccccatactaccacagctgatgctctctggaaggcaacacctcctggcaggagaccagccagcacaaaaatagagcattaaaccacgaaagctaagaacccccacagagcccattgcgccccccaacccctaccccctgcaccagaacaggcactggtaacctataaaggaaaatctgtgagattaacagcagatttctcagcagaaagcctacaagctagaagggactggggccctatcttcagcctcctcaaacaaaacaattatcagccaagaattttgtacccagtgaaattaagcatcatatatgaaggaaagatacagtctttttcagaaaaacaaatgctgagaaaatttgccattaccaagccaccactacaagaactgctagaaggagctctaaatcttgaaacaaatcctggaaacacaacaaaacagaacctcttttttttttaaattattattattatactttaagttttagggtacatgtgccatgccggtgtgctgcacccattaactcgtcatttagcattaggtatatctcctaatgctatccctcccccttccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccatgtccctacaaaggacatgaactcatcattttttatggctgcatagctttccatggtgtatatgtgccacattttcttaatccagtctatcattgttggacatttggattggttccaagtctttgctattgtgaatagtgccgcaataaacatacgtgtgcatgtgtctttatagcagcatgatttatagtcctttgggtatatacccggtaatgggatggctgggtcaaatggtatttctagttctagatccctgaggaatcgccacactgacttccacaatggttgaactagttgacagtcccaccaacagtgtaaaagtattcctatttctccacatcctctccagcacctgttgtttcctgacttttgaatgattgccattctaactgatgtgagatggtatctcattgtggttttgatttgcatttctctgatggccagtgatggtgagcattttttcatgtgttttttggctgcataaatgtcttcttttgagaagtgtctgttcatatccttcgcccactttctgatggggttgtttgtttttttcttgtgaatttgtttgagttcattgtagattctggatgttagccctttgtcagatgagtaggttgcgaaaattttctcccattttgtaggttgcctgttcactctgatggtagtttcttttgctgtgcagaagctctttagtttaattagatcccatttatcaattttggcttttgttgccattgcttttggtgttttagacgtgaagtccttgcccatgcctgtgtcctgaatggtaatgcctgggttttcttctagggtttttatggttttaggtctaacatgtaagtctttaatccatcttgaattaatttttgtataaggtgtaaggaagggatccagtttcagctttctaaatatggctagccagttttcccagaaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggtttgacttggtgatgcaggctcttttttggttccatatgaactttaaagtagttttttccaattctgtgaagaaagtcatgggtagcttgatggggatggcattgaatctttaaattaccttgggcaatacggccattttcacgatattgattcttcctacccatgagcatggaatgttcttccatttgtttgtatcctcttttatttcattgagcagtggtttgcagttctccttgaagaagtccttcatgttgcttgtaagttggattcataggtattttattctctttgaagcaattgtgaatgggagtttactgatgatttggctctctgtttgtctgttattggtgtataagaatgcttgtgatttttgcacagaacctctttaaagcgtaaatcacaaaggacctgtaaaacaaaaatacaagctaaaaagcgaaaacaaaacaaaacaaaagtatacaggcaacaaagagcatgatgaatgcaatggtacctcacatttcgatactgacattgaatgtaaatggcctaaatgctccacttaaaagatgcagaactgcagaatggataagaactcaccaaccaactatctgctgccttcaggagactcacctaacacataaggaccaacataaacttaaagtaaaggggtggaaaagactttccatgcaaatggacaccaaaagccagcagaggtagctattcttgtgtcacacaaaacaaactttaaagcaatagcagttaaaagagacaaagagggatattatataatggtaaaaggccttctccaacaggaatatgtcacaatgctaaacatatattcacttaacaatggagcccccaaatttataaaacaattactaacagacctaagaaatgagatagacagcaacacaacaatagtgggggacttcagtacttcactgacagcactagacaggtcatcaagacaaaaagtcaacaaagaaacaatggatttaaactgtaccttggaacaaatggacttaacagatatatacagaacaactgcaaaatatacattctattcaacagtgcatggaactttctccaagatagaccatatgataggccataaaatgagccttagtgaatttaagaaaattgaattatatcaagcactctgtcagaccacagtggaataaaactggaaatcaactccaaatggaatcttcaaaaccatgcaaatacatggaaattaaataacctgctcctgaatgagcattgtgtcaaaaatgaaatcaagatggaaattatacaattatttgaactgaacaacaataatgacacaacttatcaaaacctctgggatacagcaaaggtggtgctaagaggaaagttcatagccctaaatgcctacatcaaaaagactgaaagagcaaaaaagacaatctacagtcacacctcagggatctagaaacaagaacaaaccaaacccaaacccagcagaagaaaggaaataatcaagatcagagcagaactaaatgaaattgaaacaaaaaaaaaccatacaaaaaaataaataaataaatgaaacaaaacctggttctttgagaaaataaataaaattgatagaccattagcaagattaaccaagaaaagaagagagaaaatccaaataacttcactaagaaatgaaacaggagatattacaactgacaccactgaaatacaaaagatattcaaggctactatgaacacctttatgcacataaactagaaaacctagaagagatggataaattcctggaaaaatacaacactcctagcttaaatcaggaagaattagatacactgaacagatcaataacaagcagagagattgaaatggtacttaaaaaattatcaacaaaaagaagtccaagacccgacagattcacagcagcattctaccagacattcaaagaattggtaccaatccttttgacactattccacaagatagagaaagaaggaaccttccctaattcgttctatgaagccagcatcaccctagtaccaaaaccaggaaaggacataaccaaaaaagaaaactacagatcaatatccttgataaacatagatggtaaaatccttaacaaaatactagctgactgaatccaacaacatatcaaaaagataatccaccatgatcaagtgggtttcataccaggggtgcagagatggtttaatgtacacaagtcaataaatgtgatacaccacataaacagaattaaaaacaaaaattccatgatcatctcaatagatgcagaaaaagcattcaacaaaatccagcatccctttatgattaaagctctcagcaaaatcagcatacaagggacatacattaatgtaataaaaactatctatgacaaacccacagccaacgtaatactgaatggggaaaagttgaaagaattccctctgagaactggaacaagacaatgatgcccactctcaccactcttcttcaacatagtaatggaagtcctagcaagagcaatcagacaagagggagaaataaagggcatccaaatcggtaaagaggaagtcaaactgtcactgtttgctgatgatatgattatttaccttgaaaactctaagaactcctccagcaagctcctagaactgataaatgaattcaagaaagtttctggatacaagattaatgtacacaaatcagtagctcttctatataccaacagtgaccaaggggagaatcaaatcaagaactcaacccattttacaatagctgtaaaaaaaataaaataaaatacttaagaatatacctaacaaaggagtcgagagacttctacaaggaaaactacaaaacactgctgaaaggaatcatagacaatacaaacaaatgggaacacatcccgtgatcatggatgggtagaatcaatattgtgaaaatgcccatactgccaaaagcaacctacaaattcaacacaatccccatcaaaataacaccatcattcttcacagaattagaaaaaacaattctaaaactcagatggaaccaaaaaagagcctgcatagccaaagcaagaccaagcaaaaagtacaaatctggaggcatcacactacctgatttcaaattatactataaggccatagtcaccaaaatggcatggtactggtataaaaatagacatatagaccaatggaacagaatagagaacccggagataaacccaaatacttacagccaactgatcttcaacaaagcaaacaaaaacataaagtggggaaaaggataaccttttcaacaaatggtgctgagataattggctagccacacataggagaatgaaactagatcctatctctcaccgtatacaaaaatcaactcaagatggattaagggcttaaacctaagacgtgaaactatgaaattttagaagataactttggaaaaacccttctagacattggcttaggcaaggatttcatgaccaagaacccaaaagcaaatgcaataaaaacaaagataaatagctgggacctcattaaactttacgagcttttgcagggcaaaaggaacagtcagcagagtaaacagacaacccacagagtgggagaaaaatcttcacaatctatacctctgacaaagggtagtatccagaatctacaaggaccccaaacaaatcagtaagaaaaaaacaaacaatcccatcaaaaagtaggctaagggcatgagtaggcaattcacaaaagaagatatacaaatggcaagcaaacatatgaaaaaatgctcaacatcactaatgatcaaggaaatgcaaatcaaaaacacaaaatgtgataccaccgtacttctgcaagaatggccataataaaaaaattttaaaaaacagtagatgttggcatggaaggggtgatcaggaaacacttctacactgctggtgggaatgcaaactagtacagccattatgggaaacagtgtggggattccttaaagaactaaaagtagaactaccacttgatccagcagtcccactactaggtatctacccagaggaaaagaagtcattatttgaaaaagacacttgtacacgtatgtttatagcagcacaattcacaattgcaaaactgtggaactaacccaaatgtccatcagtcaataagtggataaagaaactgtggtgtacagatatatatacaatgaaatactacacagctatgaaaaggaatgaattaacagcatttgcagtgacctggatgagattggagactattattctaagtgaagtaactcaggaatagaaaagcaaacatcatatgttctcactgatatgtgggatctaagctatgaggacacaaagatataagaatgatacaatggactttggggacttggggggaagagtgggaggggggtgagggataaaagattacaaatatggtgcagtgtatactgcttgggtgatgggtgcaccaaaatctcacaaatcaccactaaagaacttacttatataactaaatataccacctgtaccctaataacttatggaaaaaaattttataaaaagtaatagatttaagtcagaagtttattgaagcaaagtaaagtacattcggaagggaccaagtggaaaatttaaaagattgagtgccccgcttgatcattggttcaaggcttttatagagttactgtatcctgattcttcctgatctcctcccctcatccttcttgggggaactgttggctaatccttgcatgcgcagtaacttgctaatatctgtcaggggctgcatgtgccgtttggtggctgaagttgtgtgtatgctctccatgacaatttttcgttactggtctagtgcccccaaaggaaggtcacatatcaggcaaactctgacgttttgccccttcttgagcatgcctggacatatccccgaaggaaggccaaactccgccattttgccccttactgcagatgcctggtcatgtttgcttagttcctgggatcttatgaggaagttgttgctcataagctcaagatgtttcctgtttgggaggaaattttccccttcttggtgccagccatgaccatctgtcattcccaaggaggcccctgacaattgcatgacagtcacctgactgttgcctgacattccttggggcactctcctaccctgctcatatctgcctatctgcctaagtaacatgaagacattttaaaccttctcagtggttctcccatttcttctctctctctctcccccactttcccttcaaaccacctcaaaactcctttctatttctactcagcaaaatggagattaaaacctcactaaaatgtgtctttgcccacccctgccttcccatttcacagcgcacttctttcttcaaacagatttagatttacagaggaaaaaaggcagaaattctctttaccggcttcagacacttaaagaaaatctgtccttttcatctctacacgttaaaatatttgctataataagtgtagattcaagagccatttggacatatctggcttttaaatagtgttgactaatgaccaacttaacttagatctttgaatctatgtgtggtgttatgatatatattagttttcatctgaggtctagctcataactcccacagcccttgttacagtcttttgttataatgttgggtgtgttaggcctcaggggcaggcccctgaccttctccttctctcctttcacctgttcctgcctttctgattgtggcttttaagaccttccccagagagagtactgccctataccctgggggaaggaatgctgatgtcatgaagcctccataaaatcccagaaggacagggttcagtgagcttccacatagctgaacacttggactttcatggaggttggcacagccaggtaaggcatggaagctccacaccccttcccccatacctcaccctatatgcatctcttaatcggtaacatttgcaatatcctttataataaactagcaaacataagtaagtgttcccctgggttctgtgagccactccagcaaattaattgaacccaaagagaggattatgagtatgccaacttggaggtggccggttagaagctccagaggcccacacttgtgactggtgtggtggggggcagtcttgggaactgaaccttcaaccggtgggatctgacattatctccaggtagacagcgttggaactgaattacaggacacccagctagtgttggctgcttggtgtgggggggaaacctcacatgtttgttcgtagaaggcttcatctgtgttgatgatttttgtggtgtgagagtagaggaaaaatgccatcagggagagttttctctacaccctatagctcctagatgctttttatttaagacattcaaaccttgtgaaaaacaaacaaacacaaaaatctttttatttaagacggtcaaaccttgttcaaaacagcacagacattaactcggaatttaggatttattattgattaattgacattatcttcagtctgttcatattattaagtgatataagtcaggtacacacacacatgtatggggagtgtgtgggagtgtctgcatgaagtatactgtcagaaaatatactcatttcaaagaaacactgatttaggccctggcaaataaggaaacatttctatttcttctagaaataacacattcatttgccaacatctgatctatccatatgacctcttaatacacacatgaaataataaagtgtatttttcattcatttaataagcatgtgattcacgtgacactgtaagccttttttttttttttttttttttttttgagacagaccctttttctgtcgcccaggctggagtgcagtggtgtgatctctgctcactgcaacctccacctcctgagttcaagcgattctcctgcctcagcctcccaagtagccgggactacaggcacgggacaccacgcctggctaatttttttgtattttttgtagagacagggtttcgccatgttggccagactggtctgaaactcctgacctcaggtgatctgcccacctcggcctcccaaagtgctgggattaaaggcgtgagccactgcgcctgggcgagcatttttttttattccagtgtttctcgttaatctaccccatggcgttttatttcaggttgtatgtatgccagagatgaaaaaaggcaaatgacagaagagcaagtatatggagaaagataggagggacttgagaaaacttggcaatttactaaaatgaaatggcattgtttccatatttaccaaaaacagacaaacaaacctaatcattcctctcattttgatcagctttcatgtatattttctaggcctaatcaaaatcttctttggtgtcacaaaataatggaagagacatgtattggtttaggctcctgcagcagtagaccccaatataaggaatattagttgtttatttaggaaattcaagaaacctaagtaaaggagtagggaagtgagacaggaaatggaaggatctctgaaaaaatacacatcatcaagtccgttcccacagagggaaacaggagctcagtccccattgttgggttctggaagacagtgtggaacagaccccagagttatcccaactgtgagatgaggaagctggggtgcttttcaccaactcttcatccatcacctgcttccgggggtcattaacaatccaccactcccaggttatttatgctcaggccaggcatgtaactgcagccagaaaatagcccttgccaagactcacaggaattaaaaaccttcaggcaaggagctactggtctttgtaataataagctttgagaggcgggtattcagaggctatgggcaccaataacttcccttatgtgagtcataaacacaaagttaattttgtttgcatgtgtatacaagtattttgaatgaatgcttctctttgttttgtgtgtttggaaaatttaaacaaaattattattgtttttgtattggtatttaaacatctgaatatgtaacatcaaagatgatattaaaaagtataaagcaaattatcacaaaatcagatgtgcagttacatgtttacttgaaattctctctagactacatttgaaataggagcttccatagggggaaatttaaattttttttacaagttgtttaattataatgtgctttaaaaacactttagcatatcataaaccttcaaaacaaaatgagtaatcatcttctgagatccatagaaaatgtttcttaaatgtcactttcaattaccacttctggagctaacttgcaaaacaattgtgtttccaccaactgaaatatgttttcaccaaatttaagataatctgtggtcagtgtgagctttgtcttgatttaggaggaggaaagcaaagttccatttatgaatactttgaaaattttcagaaattctcctaaattgtttcagcaaccaggccaaaagagaggcctggaatcccaaggtgagaggaaactttaaaagttacacttatggccaggcacggtggctcacaccgtaattccagcactttgggagactgaaatgggtggatcacttgaggccaggagttcaggaccagcctggtcaacatggtgaaaccccatctctactaaaaatacaaaaattagcctggtgtggtggtgcatacctgtaatcccagccacttggcaggctgagacatgagaatcacttgcacccaggagacagaggctgcagtgagtgagatcatcccactgcactccaacctagacaacagagtgacactctgtctcaaaaaaaaaaaaaaaaaaaaagtttcacttgtgccttggggttggctgcctgctatcatatttttgttgtgttcttctaccccaagctccagtacctcccctcacagaaatcacctctcctaccaaccccaagggaacccattccatttttattagagagttcttctttacatggcctcaagtcttttcatcaagatttactgatagaataacagtaaatccacattactccaggtgtctctttgcccttacctagcctttgtgtctatgccattcttctcaaggaaattgccttcctttatcagctttaaaagtccatatttgggatcccctctcctggaaacattctctgactatccagcccagataattttttttctctgctttctcattataacattcatgatctgtgtcattcattcattcattcatttgcccaatatttcttgagtgcttcctaagttcaggcactgttctaggtactggggacataggaggatagaagccagtcaaattttgcactcactgaaactttactttagtaggtaagaatctatagtttaaaaaaaaattcacatatgaggcctgtgaagcaaataaagcaataatgtggtggttttcatggacattatgtctttcactacccgtccctctttttgttgtaaactctctaaggcaagtataacctcatctatacattagtatttatttaccacaaggacccataagtatttattgatatatcttcctaagtatgtgataatattctaaatagatagtagatttaatcattgggatttatgtgaagttggattaaatagataacatgataattacatttagtattgcatggaaggacacattttctcacttatagaagcctaaacaaatgtcacaatgttgatagattcctttataggatgttaactctgaagctgtcgtgaaaatgtgtgaactagtttcactttcaacttgatccttttggaatcatgacagattttgctagcccttaattcttctgcaatctttgttgatccctcctatttcaatctcataagacacttatctctcctccagaaagatctgaagggttaagtcacctatttatacctaattacagtgagccctgtgttggatttttaagggataaaaggaagtatcagatctcagttaacttatgtactgtctacagtgcctaacaatgacacaggatgactcagttaaggagaaaaatactccatttatcagcacagaattcttccctttaagctatcatatggtagctaaccttgcctaaccttgcgagtttaaccttgctttttacgtgcatgcacgcgtgtgtgtgtgtgtgtgtgtgtgtgttactaatttctaactgtaccagctcctgaattaatatttggcaacatcaatattccttgtataatgaagaagcatggtccaagagacttggatgtgacctctctaaacatcaacttacagctgcaaaataaggaataagttgtaattattccttatttgtaacaactaccttacagtgttgttttgaagattagaagagaatatatagatgaagtacccagtggacagtaggtattgaataaatgttagtttccttccaccttctctggcttatgtaacaaaattactcattctactagtcactcagactttagttaatcattagctaaagagtaacaatgcaggattttttttttaataaattggctaggattggttttatgcctggatggaataggcacttgccatttcatcacaattcaaaattcctcctgaaggcctgaaggcctgaaatgtttaccattggaaactaatcccactgtatggttactattatttattatatctattaacttataaaatattaaaatataaagtaaatattaccctactgatgcattagccactcaacataaatgagtttcttggagattaataaagcagtacatcagtatgtcccaaacaatggctaaaaggaaacctagtaaccaccccgaccccaaacttgttttgttaggccagtcagatttttttttttcattttgaattagcatcacgattgaaagtggaaagatctcacatataacttcacatttctctgtacaattgagaaacgttggctatgttggctctctgaatagcagctacctcctttcaaggtttgtatttacaatatttcccacccccatgagtccttattatcctgacactgaggacaaatatgagttgctgtccatcagcattccaaagctgtttttttttttgttttttttttcttacacttagcctacttcactccctaacaccaccagcctgatttctgagggggcctgaggtaggaggaggagaatggagagcactttctctgagagccgccattttaacagatcattaaagacacgatattcacatgacggttgcttactctctgatgaaaactacaaaaacagaatacacagggaaggtaatctgaaggtgatacctttttcctatgatccttggccttataaccactaatcaagcctgagggccgaagttcctgcctcatctctgcctgatgttacgaactaggcaggctagcagaggcaacaggcaacctgggcacctgaagagctacctggataacctagaagaacagtaggaggttaaagatgaggacaagtctatcaaaacaaaagcctgtcaagaccagaaagagaaagtcacacttttgactttacagtttgtgctgggctgacacaaaggcctcagttaacaccaaatacaacttccatagacttcaagtttccctcatatttttcctgggtcactattccagagttgagaaactgaactacatctaatattttattaaaataaaattgaagattattagaaaagtttattagtcaatagtaaaacgttatttggttagctttcttaaacaatggcatttatagatatctgattatcccaacaaaaatcttcaaatggttcatggacgctttgtcaagcttttgtgccacctgagagaaaaaaagataaatggggaggtataatgttaattttgtagcctttgcttaatgtttatttttgaaatgcctatcattttctatcagtatctgaaactccatggatttctattagccttcaccaataattacatttgaaagcatccagaagagacaatccttaccacagtctcttttaaactcttaatggctgtcacaaaattctatttttcattttctctaagagcattctattaaactgttcctagttattagctttcataaaggcacacagaaaatgtttcctctacagccacaaatattcctaaagcagaatcatagtaaaacagctgtgataatgttttattcattccagaatcctaatgattgaacaaaagagagacagtcttaagagttaacatctattgagtccgtgactgcgtgcattgttctttcaagtattttacctgcactatttaatgtaattctcccagccactctgatttcactcattttacaattgaggagactgaggcatagaaaactaaagcaatttggctggagtaagggccaggttgggacttataccttggcggtctgcctacaaggtgttcctcaccaccatctgacactgctttctctgtgtagcccagagtgtcagcctcagtgcttcaacttgagctttcaggatctatttaaagatggaaaatatagttacattatgtcaccatttgagatgcagaaagacagggccaccattttgcacaattctgaaagcacaattcatgctgtggtttgtaaaaatggtactccctagagttgggcaatggacagctcacacagagatgcagtggccctgctaaactaatgccttacataaaagagttttactcttcattcccttaaatgattcttagtaacactggctgacacacacacaaaacagtttctaagtaggtctgtccgcatactatgatcactggtcaacattaagtttccacaattaattttacataatccaaagactgccaagcagtttatctgggtaaactaaacattctgtagtcatttattctgcttccagtcatgcccagcaacaggttgagaagacaaatgttctcagaaatgatctccaaggagttgggagcaggctgcttatacgtctaattcaccagaataggtgagcgtggtcgtggtgaccttttcatactgttgcagagctgagtatgaagagatgactcacagtcctccaatgcaacacaggtgaccctgcagccagattttgccttcagtggtatgtgactcccatggggtcaggagagtatctcagacattgaaatttgacctaatggcctacctacctgcacacgcaccctgcccacttacagaagggcaagaactctgcattactgaggccttgttattattatagttcctatttaggtaagaacgcaatggagaaaaaatgcatttggttattgggcctctgtttgaatatcctgtgctttttgccaaacaatgcattctacataatcttaaaaaacaaagtccatttcaaagaacaaaaataatgaccatatccactgagcaattgagcagaatgggaatcggagttttaaactctgatatatctgttttccttagggctgaaatcttcttttcatggttctagtttctctaattgaaataagaacctaaccctgttcaaaactacatctctgggaatgagtgaaaaattaatgatcctcctattttgttggatcataataatgactctcatcctggtggggccaccagcaatgctattcttctcagactctatcttagttcctaagccactcaccaggtatttaaaagaatgatttaacacaactagaatcatttaaataactgtattttttaagaaagccatattattgctttagtttggtcattcatatatccaaaccttggactcatcatcttgcaatctcatgtgttcagttattccagagaaaacattaaggagaattgtattcttcttcccagctaaattttaggtcctcaaagctggcaaccacaatttatgctttctaaaaatcatctatgatactaagtatgagctggatcatgaataaaacccttgtaacaataaatgcttgatgacttacttcatctcattagcaagggaaggtaactcataattatcaaggtactacaggaaatagggcactatctggaaatgctaaatacatctccttgcatgaatcacttcttaccagaattccctttctttccagatcccacctccagggttctgtggtccataccaggcactacattcctcaggggctacagcctatgagcgtctcatggggctatgaaaccatttgagacctggaaaatgaagtaattgaatacaaacagaaaactgcaaaatgaggactaacatttaattaaatgttcaaagcataagattatgtcgacttcaataattgtcaaatgagtattcttaacattttactaaattaaaaaaacttatgtgctgagttttttattttacaagtatctccaagtatgctggatgattgcaaagaaaatcaaggccagtcattggttaaatgagtttaatagtagccacataatttcaaaagcaaaattataaagacccttcccagactgttgatagcaaaaataatctacgttgtggaaagtgggtccatgttaatatgttagatataagtagtgaggcctaaaaaggtattaaaacatctttgcttaaggtactacctatttgcaagattgttattttaaaaatagcttatgttttaaattgttattgctttttatcactctaataagaatttatagttgctgtaagataacaagaaaaaggttaactatctgcagagatgcctgagagtcagccagggagtaacttaaatcctgcaggaatctgactcactgaagactgtcaactgaatgaaggcttaaatttcatggtcttgggtgggagaactttttcatattctttccccatatggaataacaatctgccctgaaaacagggagtattttggcatgatctctttttgcttatttgccttccattttccataaagcaacttttgccaagcaccatacttaagactcaacttttttgcaaaaatatcagacaaagcactgtctttaagaacacagagaacacactagatcccttcttctgaaaatcactgttctatgttgtttgtggatatttttttagcattcactgcatgcctggaatgaataggctgtgtttctccccaaaagagcacaaattaatatacaaggtcaggttaaatagttaagtctgctttcctatcccttatacagaagctatccattcaaaaaaaaaaaaaaaaaacttctttttactttttttaatttttaattttggtgcatacatagtaggtgtatatatttgtggaatacatacaaacatacaatgcataataatcacatcatggtaaatgggtatgcatcacctcaagcatttatcctttttttatgttacaaacaatccaattttaccctataattgcttaaaaaacatacaataaattgttaactatagtcaccctgttgtactatcaaatattagctcttattgattctatctaattacatttttttatacccgctaagtatcccacccttccctccacgctaccctacctaacctccggaaactgtcttctgctctctatctccttcgtttgttttaatttttagctcccacaaaaagggagaacatgtgaagtttgtgtttctgtgagtaacttatttcacctaacataattatctccacttccatccgtattgttgcagatgacaggacctcattcttttttatggctaaatagtactacattatatatatgcaccatattttctttatctatttgcctgttgatagaaatttagattgcttccaaatcctggctattgttaatagtgctgcaataaacatgggagtatagataactctttgatattttgactttctttcttttgggtatgtacttagcagtgggattgctagatcatatggtagctctatttttagtcttttgaggagtcttcaaactgttctccatagtggttgtactaatttacattcccatcaaaagtgtaccagggttcccttttctttacatcctcaccagcatttcttattatttgtcttttgcataaaagccattttagctggagtgagatgacatctcacaatagttttgatttgcatttctctgacgatcaatgatgttgagcaccttttcatatacttgtttaccatttttatgtcttcttttgagaaatgtgtgttcagatgttttgcctatttttaaatcagattaattttttcctgtagagttgtttgagcttcttatatattctgattattaatcccttgtcagatggatagtttgcaaatatttcctcccattatgtgggttgtctcttcactttgtcaattgttcctttgctgtgcagaagctttttaatttgatgtgatcctatttgtcccatttgtccatttttgctttggttgcctatgcttgtagggtattacttaagaaattgttacccagtccaatgttctagagactttcttcaatgttttcttttagtagtttcatagttcagagtcttagacttaagtctttcatccattttgacttgatttttgtatatggcaaaagatagaagtctagtttccttcttctgcatgtggatatccagttttcccagcaccatttattaaggagactgtcttttcccaaagtatatacttggcgcctttgttgaaaatgagttcgctgtagatgtatggattcatttctgggttcaaaactggtattccagttttgttctttttgctcgggatacctttggctattttgagtcttttatagtttcatataaattttaggattttttttctatttctgggaagaatgtccttggtatttttatagggactacattgaatctgtagattgctttgggtagtatgaacgttttaacaatattgatccttccaattcatgaatgtggaatatctttccatttttttgtgttctctttttttccattagtatttgatagttgatagatcattgtagacttttttggtttagttaaccctaggtacttaattttatttgtacctattgcaaatgggattactttctccatttctttttcagattgttcactgttggcatgtagaaatgctactaatttttgtatgtttgttttgtatcctacaactttgctgaatttatttatcagttctaatagtgttttggtggaatcttcaggtttttccaaatttaagatcatattttctgcaaatgggataatttgccttcttcctttcaaatttctttctttggtctgattgttctagcaaggacttccagtattattaatatattgaatactagtggtgaaagtgggcatccttatcttgtcccacctcttggaagaagagtcttcagttataccctattcagtatgataccagctgtgagtctgttatatatgacttttattgtgttgaggtatttccttttatacccgattttttgaggatttttatcatgaagggatgttgaattttatcaaatgcttattcagcatctgttgaaatggtcatatggtttttgtccttcctgtcttccttttagtaaaagtgattttctctggtggcgtgttttaattttttgctttttattttttgagaacctgttgtatattttttgatttgcgattaccaggaggcttgtaaataatatattgtaactcattattttaaactgataacaacttaacactgattgcataaacaaactaacaagcaaagggaaaaccaataaaaactctacattttaactttgtcccccgctttaaaactttctgttgtctttatatcttattgtattgtctgtatttcaaaaaatagttgtagttattatttttgatcagtttatcttttattctttctatttaagatatgagttgtttacatactataataacagtgttataatattctgtgtttttctgtgtatttactaatgctagtgagctttgttcctccagatgatttcttattgctcattaatatgcttttctttcagattgaagagaattctttagcatttcttacaggataggtctggtgttgatgacatccctcagcttttgtttgtttgggaaagtcttgatttctccatgtttggagaatatttttacaggatatactagcctgagataaaagtttttttccctttagcactgtgaatatgtctcctgccctataaggtttccactgagaagtctgctgccagatatattggaactccagtgtatgttttttctttattttttcttgccgcttttcagattctttcttatctttgacctttgtgagtttgagtattgaatgccttgagctagtcttctttgggttatatctgcttggtgttctataaccttattatacttgaatattgttatatttctctaggtttaggaaggtctctgttattttccctttgaataaattttctacccccatctctctttctaacttttttttaaggtcaataactcttagatttgcccttttgagactattttctaagtcttctaggaatgcctctttcttttttattattttttcttttgtcttctctttgtattttcaagtaggctgtcttcaagctcacagttctttcttctgcttgattgttttgtgctgttaagagactctgagacatttttcagtatgtcagttgcgtgttttaactccagaatttccgcttgattcttttaaattattttaatctctttgttgaatttatctgataggattctgaattccttctgtgtgttatcttgaattccattgagtttcctctgtctaaaaggtcacatatctctgtctctccaggactggtcactgatgccttatttagtttgtttggtgatgtcatgttttcctggataggctttatgcttgtggatgttcgttgttgtctgggcattgaagagttgggtatttattgtagccttgcagtctgggcttgtttgtacctgtccttcttggtgaggctttccagatgcttgaagaaacttgggtgttgtggtctgagttttgggtcactgcaggaatatctgcattagggagcactccaagcccagtaacactgtggctcttgcagaggtaccaccttagtagtcttggataatatccagagtcattctctggattaccaggcagagactcttttttctcttctcttactttctcccaaacaaacagattcagtctcagtctgtctgtctgtctgtctgtctctctctctctctctctgtgtgtgtctctgtttcctggatctgggggaggggtaacacaaatacccctgtggccaccaccactgggactgcatagggtcagacctgaagccagcatagcactgggtcttgcccaaagcctgcagtaaccactgcttggctcctgcctatgtttgctcaaggcactagggctctataatcagcaggtggtaaagccagccaggcttgtatccttcccttcaagacaactagttcctcctagtcctgggcaggtctagagatgacgtccaggagccagggcctggagtcagaaatcttaggaatctaccggtactctattctacggtgggtgagctggcacccaagtcacaagacaaagtccttcccactcttccttctcctttccacaagcagaggagtctctccctgtggccaccactgccccaggcctgcgacaagtactgtctggctactgctgatgttcattcaaggcccaggggctcttcaatcagcttgtggtgaatgctgccaggcctaggaatctattttggggcagtgggcccacctgtaagccagggaaggtccagaaataccatctaaagccaagccctggaatcaggaacccctagaacccctttggtgctttaccctgctgtggctaagctggtacctaagctgatttttggttcttatgaaggtgcatgaaggtgcttttttgtgtggagagttgttcaatttgttgttcctttgggaggctgctatttagccatatggctccacctccctctccatccaaaaagaaaactttaaatgaaaatatacatccaaagaaagtgtttttgaaataaaaaataaatggtcttaattccaaggaaagaaccaacatagtaaagtaaaaatgcattttttccaaaagttacttgtttgatcacatattgtattttattttaatgaaatatctagaataggtaagtccatagagaatacaaaacaggttagtagttgccagggaatgtgagtgtgcagaatgaggagtcattgcttaatggcactgttttcaagagttacttttgagtacacttgcagtctggtatctaaataattgaaatatttgaaagtcgtgattcctagaataaaaacagtgactaacttttaatgatttcaatgtcatgtgcacaaaaaaaccatgtccagagtaataagtttacccattctaccattcttttcaaagaattgcttaaataagttttaaaaaatttcctattgagatgttacttaaaatacgatttgtttagttctcaaggttatgctttccccaggttatgcttcatttgggtaatctaagtttaagtcctaatgtaagacctagggcatggtacttaacttcctgtagacctcagttttcttgactgtgtggtggaagaaataatagtacctagcttgtgagtttgttttaaatgttaaatgagagaacatgtggaacatcttacccagtgcctggcacatggtgagcaatcaataaatgggagttcatcctgtcatcttcagatttctcttctggagccagccaggcttgagttctgacctggttcatccactgaacttgtaggggaagcacttagtgcccttcggtcctctcatccagtacatggatatacagtcttcatgtggttgatacaaatacgaatgtgctaatgcatctttaccaaaaagagaggtaaaagaaaggaaggataatcctgccagagatacatatgcaaagatctgaaagtaatcgagagtgaggggttgcagattggacaacacttagtagtggctccagataaggttcttaaagactggccaggatgcagccttttcatccagagaaacagccatctcattcatagacagtggtgactgattggcagattttataagatgacacaaacaccctccccattgtcctgccaaaatgtggggaaactcttcctggaaaagttatttctttgaattgagcttccaaaaggttcctattagaattcaaatactctgtctgggttgaatatcacattgcataatagtttctccagattaaggccatttttcctaaatatttaacaaaaaatttttcgcttcttatcaatgatgctggcgttggttcagtgcctgcataagacttcttccagtgtatttctttaccctggcaaccagttcctttttctttgggagaattttttttttaattataacactattgtaggaactcctttttggcacagaaggcatctaaagtaacttttagagatagaggcttatgaaaaacaagaaagaggcaagactcagtttttgaaatctaattccagccatgaagcaaatgccacaaaagggcacaggaagaaaatctgtaaagggcttatctaccaccgttgaccaaagatttattctgctgttaagcaaataccttgtaagccagatattgtgctaggtattctgaatacaaagatgcagaagcctcattccctgttttctttttttttttttttattatactttaagttttagggtacatgtgcacattgtgcaggttagttacatatgtatacatgtgccatgctggtgcactgcacccactaacgcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatgaacagacacttctcaaaagaagacatttatgcagccaaaaaacacatgaaaaaatgctcatcatcattccctgttttcaaagaaactcacagcattatggaggcccaggtttctatttgggcctccataatgccttgtgctctaccaagaatggtaaaacaatcctttccagtaggagttcctagttagtggcttatagttaaccaaatgaagagaggatgaccatatggtgctgataaattgaaagaaattaggatgaacatctagagatttgcatggccagacacctaattcagattgcagagcagcaggatgggaggcgtagtcctgatttaactcttgatcaaaaagaggggtaaaagaaaagaaagataatcctgccagaaatgcgtgtgcaaagatctgaaagtgatcaagagcaagggattgcagattggacagcatgttttctcatttaatcccagaggaaccctgggaggattctaggtgtgcatattgtccttattttgtagaagaaggtactgaatcttaaagagataatgtgttttcaaagcttacagagtccaaatcgatagctaaacagtgtctgtgggatttgaatccccctgtgatgttcactgtgtgttgccatatactgcaaatgtgttataaaataataattataataaacaaaattaacctgagatattcccagattgaatcaatccaaggagactgaacttctgagtttgtcttggagttagttgggctttactgctacttatgctagatcttgaaggcagagtaggaaatatacttagcagggaagtgggagaaaggtgagaggttccccaggcaggggaaacaaagtgagcagatttggggcaaggtgtgtgagattgtgtggttggcaatatagggtgggaaaaattagttatcaagggcaaagctgaatagcagattgaacccaaatggtagaagtttttatttaacacacaaaaaaggctgaaattgatcctgtaaggaatatgaagctatagaaggtttttcatcacaggctttgacattttaaggtttgtatctttgaaagataatccaaagataagagaaaaaaaccttagatgtgtaaaatagaagtcaggaaaactacacaagctatgtgtaaagggagtcaaggggacaggatccaaaggaagacaaaagcacaaaccaattattttaaatcaaatactagtgcagtaacatatatttttaagttttaaagctgcttttctccatagcttattgattactcttttaaaacttatttttaatagcagatattatttattgattccttaccattttctagatactttgctaaggttttacatgtcttttttagtcctcagaaaattctcttctatctccattttatagctgaggaaactgaagccagggaaggttaaataatttgtttgcaatcaaacaactagtgattggtggaatttggatttgcaaccaggcagtctgactccaaaggcctcttcttaacttgatcctacatacccttcctaaatagtaggcgtttttctcagagcagctgttttacattagagaaaacttatttgtaatctgtgatcaaggagaaactgcctgagttgcctggattattttggcatttttaatatgtacaagaaaaatgttatcaaataaatgtaaatttaaaggtcctgatgagagtttactttctaataaaacaattttcaacatttcccattacatcagaaactaaattattattaaaacacatcttgtgttcatttatttttgacaggctgcttttcacatctttttttttttttttttttttttttgagctggagtttcactcttgtcgcccaggttggagtccaatgacacgatctcggctcactgcaacctcctcctcccaagttgaagcaattctcctgcctcagcctcccaagtagctgggattacaggtgctcgccaccacacccagctaagttttgtatttttttagtagagacggggtttcaccatgtttgccaggctggtctcaaactcctgacctcaggtgatccacccgtctcggcctcccaaagtgctgggattataggcatgagccaccgcgcgcagcctccaatcttattttaatgaaaatctcaatttatctcagtgttagaaactagggcttcatttggcaatgtggtctttccagttgtttcatctctttcaaaagtcttttaagaattattgaagtaagttaattttaaatttttgctttatcccttgagattggtatatagagttaggaactacttgattaaatacaggaagctactataaatttgaaataagaactaaagttataatgtgaccagactgggtaagcactgataacatttgtatatatttaaacagaaaaaaaatagttagaagaataatttttaaaaacacacaccagatgttggtaaaggcaaagatatttttgctcttgactttgtctatgaaagtcaagtgaatactttgaaagaattgatgatggataaggcaagtacattgatttctcaaggtgtgaattgttatcttcaaactttgtgcttccataattgttttttctttaataatgagacatctagaccataactggctatgtgattctgaatctacctttacaacttaatctttgtgattcccctatataagatatctagagtagtcaaattcatacggacagaaagccaaatggtgcttgtcaggggctgggagaagaggagaataggaagttactattaatgagtacagggttgtcgatttggaaggatgaaaaagttctggagatggatggagataatcgttgtgcaacagggggaatatacattacaccactgatcagtatacttagaaagggttaaaatgtcaattttacgtgatgtgtattttaccataataaaaaatacttaatatttacctatgcttagagagagttgacatatagtcatttgataaataaaatttgtaaatgcgtatgcttagataaacatagaaaattgttttaaagtagaacttatagatttctagctttaaaactgtggagaaacaatcttcctatgccatttttttctttaaaaagtcactcaaaccaataattagtacaaaaaacagaaaggtacatttcatctttgaggaaactgggagatgtctgtgactctaagccacaatacataaagatagaagtaggaagagaaaaggtcaatgacttaaccaaatcagagaacaatactaaagtgaagcaaactgagctgccccagtcgcccaaaacatactttggaagatggaagagttctaaatatagcaggtgtatgaacatgtatattatatacacttctccataagccctcactctttttcagtgtagtcaacatattttgcatccctctccatggaagacagagactttgggatactaagcaaagagtaggagaaggatggctgtatgtttaactttatttaggacaattaaatgaatgtctgcaatgtgtcagtaagaccttcagcgtccttctcctacccacaccagaatgctaggaagcatatttatatccttctctagaaaaatagagataccccagaggaaaaaatctcttacaaatagtaacatttggaagaggcaaaaaaaatccccactgggcacttgatgatactgcagtaaaactcccagtacacaagcctcacccatgcacttagaacttactgtcacctttctagggtctcattcttgtgtatgaattgggatcaggaatcaatgctggagtttgaggatattacactcattgctctttgtttacattatttacatgtatttctttaataaaatttaaatatttaattcaaaataatgttaaatttgcagagattcatttaagtttagaataaagaagaacaagaaatgtgaaagagggacaagaggagaggcagaatgcaaaggaaatacagcagcacttagaaaattttaaattagatagtttttcttctgaaatccagtattgaattagtgcaaaattctgaaagtcaattacaaaattcattttatgtcaacattactgactccatgcacaaatgtttattctagttttaaaaactagtattctgtaccttttaatagccaatgtaatttgttgacaaatattgaaatttatacgttaccagaggtctcacgtattgttaccttttaaaatgatcatttattaaccagtattgcctaatgaggcaatcaaaatgtcatctgttgcataggtaacaggaaactaccattactcatgttgtgagatggtcaaagaccttatcatattttatggctaacaaactcatgatgttgtcatatatgccctcatcacagtgtttatgatacctaaaagttagtgcctaaaaattagaaacaaggacagtgaagttagattgtttaatcctgcatatcttaaagatctaacattttctagctgttaaatatgtttatcattatactagtaatgtacgtgcaccatttttattatattaattcattgccactgtacaactaaagaggatggatgaattttaaaaacttccaaaaacttggtagcattttttaatctctttctcttcctcttttctttctgtcttccacacacacacacacacacaaacacacacatacacatacatacatgcacacatacacatcatgaagagcaagctttggaatgaaatatacctgggtccaaaaattttgaacaaattgttgactttctttatgtatgaaattattattatcacatctactttggagggatgttgtgatgtataattaagaaagtatagtctacttagcatgtaggtaattaataattagtagttattattattatcctaacctgacagtttatgaaagaggtaggaaatctgaagataggaaagccttcaaaatataatactccggacttctcctttgggaattaagaaatgtagctccaagcaaggttcatgccagtaggaaagtccttgaatccaactgtattcctagtaagtgtaataaaataaaagaaacctctagaaattgcctcaaaattcccctccagataaggaaaataacacaatatttctcaataatgaggaactgctacaggagttcagtgtcttattctcattaacgttagagtacaatagagaatagcaggaaactgtaaaaactgcagtcccctggtctttttttctaaaaagttagtttgacatatctggagtactgaatttcagcatatttgagaggcctgaatatttagttgatatataatatggctctaagaaatatgctcatgatagattggaaagtatagaatatctattgtaatctgaaaataggaatttagagaacagaagatttgatagtaggcagagtatttgaaaatagtaatacttgagaaaacctgagttgtatagtaaaattactccgtaacacctcattcagttggcttcatttaatgtttaatgtttaatccatggataaatgtcataagtctcacaagtcacgctcaccattggatgataagagaaagggagatcacattttaggtgcgcacaatctacctgtatgcaattgacgctttccatgtaagtgttgccaagttgtatcggggcaccattagtggtatgagacagactttaggagttattttggactcctttttttctattaatatatcttatattttgggggcaaattataccagtatattaaatctatttacagaataaatataaagttaccttttatattcagtttaagtttttttaaaaagtgagtcaattaagaaaaatatcaaatcatggtatagatggaatgctaatatggaaagaattatgaaggtggtgttatgactgaagtttcagaaacatcaaatgacatagtcatttgattcaacaaaacatctacagatggatgacccaatggatgtatacatctatggtacagtctattgaaatgtggtaacaaccagaaagtaaaaggtccatacattatacaattcagtacaacagggaaatactgagaaataatcgcagcttctggatcaaaagcatgggccacatggttcctaaatccagtctccccatattcaggcctcctcatcagcctgcatgccatcatatgcttgcatgctaacaggaatttcgagggaaatgccatatcttttccatttggggaagcttttcagagggaaaactacaggatgcttagataacaaaacattctttcagaaatgttcatgtgagaaatggtcttacaagtggataaaactctgtaacatcaaatacatactttttttttattctgtcactaccttaaatattaggagtagaagcaaaacttaaatttaaatctcaatggtcttacaacatagcgcatctttctttctctgtaatggcaaccttgatgtaccaatccaaaaactttgagtattctggttagttccatacattgtcagattccccacttaagtttgtttttgccaggggagagggacgatttcttagtcattatggtactattatacagtctttagtagatgcccaataagtgtgttaggttttcagagaaagattcttggaagatgtagaatgttgggcaagtaagcaaggaacagcacatggggctgcactaaacttgtgtgtgtgtgacagagaagggagtagcatcaggctaaataagctcattgtaacatggatctgggggacggtagaacacaggctaattatttctggagagttgaaaactcaacagtcagacattacattctctgatcattgtcatttgctttctgaaatggcaactggaagctatttggtagaccttacatggagggaacagtgtttcaaataaatagtagttgcctaattttacttggtttgcttttgttctttcttttcccacatttaaattccaataagaaaaaaattaaacctcttcctctaaatcccctctcccctaaaaataattagtctcacaaaacttttaagtttccaaaaaaatacatgattaattaacctgctttaaaatgccagcaatatactagacatgggacagtgctaagaaagtgtgaatgtcccctggcagtcataaggaaactgaaaagcttaaggggataactatgtggaaagcaatttattggcatttaccgtaagaggcctgagagtcattgaaagaagactaagtcacaaatgcaccttgaagtgtgaccaggggagcagatgaagggtttgttgtaagaagcagccagagcctctggcggatgccgtactacattttccaagttgtttgggtgggtcacaactgcactccaacatcctgtctgcaaatgctaaataaacaccaagttcacgtcagactagagaaccaacgtactagctaatgccatttaagcaatcagaatgcttacattattttcacttggtaattcacatccaaaataattgaagttggcacacccagaggagtatatatcctctgtgtagatgttcagagagataggcaggctggtcaactgttccttctgttgggagcaattggaatcagcttagattatatctactgtaatagaaaatattttatatttaggaggtgggaaaggttttggccttcgaaataataagagatattgacaagatataaagcttcattccttactgaagagctgttaaggattagcaaacccaagtctttgtgtgtagagatgaatgaaatttgcattttttttaaaaaaaaataaggtttagaaaacattgtgcaagggaacagccttaatacgtgcagccacttgtccaggaataatacattcaatttttcagtttaaaattccagtatgttctgatccaagggtgcctgttacactctgctgaatttttaagaggtaatttacatctctacaaccaactccaaagcatgacatttcattacatccgctcaaaatgaacagctgctaagtcatcaagttctctcaactttgcttctaaagagaaaagtttagttttagtgcttcagtgaaatacttttttgaaagaatgacttttataaaattcatttgtttattatggtaaataaacaacttaatggcaaggggtgtgttccttgtaaaggtgatcacggaatgttacccagaataacacagacatctcatttcccagagaaggaaatggttttataagttttgtgaggtctcttgtctgcttggccggtttacagtgctggtctctggagctgatccgcccctttgctttgtaagtctcagcaattgacgaggctaggctgggcgctgggcttttctttttttttttttttttttttcctttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttggtaacgttcttttctctcatgcttttccccttttctcttttaagattgacgtactccttgagtatttagtaagttgtgtgatgtcgaggctttgtgaaagaaggcagtattggcggctcttttattctttattttgttcccaaactcatgtgctttaaccaaatgggtgctgattttttttttaattcctcttggactgtaacaatttatctgatgataatttttaaaggaggaaagaaacttgcagatatgttgggagttttgaaaatgaaaacttgtcatttttcagtgtttgattcagttgcttgttttcttatcttctttgcttgctgcaagcaggctggtggttgacaggctttgcccttgtctttaaaagcaataccctcacttttagcacagatgtgttagaaattaataatgttatttatatttaatcatacacatgaaacaaacttgaatttaactatgtggctaaatgtatatcaagttgcttatcattcattcatctcttatgttttattttattagaaatgattcctagtaattatatttttggttattttaatgcttttactctgatgaaaaaatatgtcagtttcaatgtattctaatgttctattatttccccaatggtgatttgatatgctaatcagcatatggcatggcccttaaggagtattttccaacaaagtaacttttttttctacaataggtatttacaaaatacttttatggctattttaggggttagtcttattttgtttttcttagtgattgattataaataactaagctcacctctttgaaatggaaataatcatacctcacactggggaaataaaagcaatgattgaagtgaggtggttgagaatgggaggaaaacaggccagcaaaatatgcattatcatgtgagcaggcaaacacacatgtaaatactcaaattatttgcgtcaggaatttagcttgtgtttttgtggataggttagcctttgctgttattgtagtgttttacagtcaaccagaaacaagaattgccccatccgcagtatttctgtgagttttaataaattatagatgaagattttgtctcttaacgttacttgccatttcttacaaaataacacgtgcaataaattattccttgagtttatttaaagaaaagattgcatctgcaaacaaatttggagagtcctgtcctttttttcctcaaacaataaatactggaaaatccttaaaatccttgtatgaattaccatagctaatataaatcaccaacatgagtaaacagaatttataatatacatgaatttaactcatttataatttataccattcctatgtgaaaagatgttactactttaaaaatagtgtttaaccaaactatttctctttttgtctaaactgccaggagatgtattttcaaattcaggtttcaattggaaataatttgttcatttcaggagatgagtaacattgacaccctttacctctctgagattatcatagtctatttttatccacaattattatattttttgttttaaattgtatgggatattttcataagtcaagccacaatttaaaatgcatttttaaatattttgatttgttaatgtgtgtatttttccatttaactaaaaatattctccatagacttggggatagaatgatttctgtgtaagaaataaatctctctctatatatgcatgattcttagatttaactacacactatagaaacctctccagttattaatcttacatctgacttaataatataaccgcttgggtatatcactgcagctgccaaaaaatttggcctgagggtataatcagctgtagtaacagttttgccattttattatccgtctatcagtcaaatattagacacatctattatatttatttatttaattacatgtataaaatcaatatagattatagatttggtatatagagaaaatatatgtttgtgtgtatatatatgtatacacatacatacacacacacatgtttacttgagcattaaaaaaacccaaacggcctctcttcttgtgcctctgcacataaaggccacaggcctcaaattgctcagagggacaatgttttctcaccagtgttgctgtctgcatttctccaccaccaccctaccctcattccttttcagttgacttcccatgagagagacctaaaactttgccatttatctctttttcagatgtttatttgtttccaggttgatctccaaaatactttgttcttgggacacatctttctggctttaccatcttcactctgattacataaatctattttgtgttccattggtctactttctccaaatctgtctactgtcctccgggattccctaaagccaaacattacgtttggaagtttgttgtattgtgcaagaatccaatgttttggattacttctttacctttttctatttgtttctctccaagtatcataaaaagcagtccacactaacttgtccttacagccttaattaaattgctatgagatattcacattttaaatgggatttcatggcaaacttgtattttatacccttcctcttattaaaggtcagcctgttataattaaaattttattaatttcaagacaaaatacaaataaccttaaaattaatctatttgtctctttgtaacataggtgtccaaatttagggtttatttaataaaggtgtatactaggttgcttttatttaaggaacagttatttatatgccacgttctagcagaaagtgattatagtatttattcttaagcattattttaaaaaaatgtgcctgcatgaaattgagaaaaactttatatattttcttatgctcataaagctaataaaattagcagattcattgattgcagaattgtttgcctttcttgcatatcttaaattcagatttagtcagttgttatatactatgaaaatattaccttacatattccttgatatctctttaacacttttataaacatttataaacatttcccagggatacttctcattaatgtaattaagacttgtgatttagtttaagtaagtaaaacattattagtcttacaaatataaatataaagagaagtttagtcaatggaagtggacttttttctttcctgctgacagaacagtgtttaggatttatgtgttacatgtaagatcattcattatgtaatctgaaaataaaagagatgctactgttcaaaatatgactgtggttgtttttaaagcaaattttaaaattggttattgtatatgtaatagtacttatacttttcattataagtattattatgtaataagtatacatgtaatacttaggtttgtagatgcagaaaaaattctggaagactctgtccaagcttttggtagtggttattttttaggagtaaaaaaaaaaatggtaggagtgaaggtaagggggactgcctctcttttcttcactgtatttgcatattgtatgtagtttttatcaataaagtattatatatgaaagtttaaaatattaaaaatatacctactatatgtattagcaagctcatctttatatatgccaatatctacttagacattaaaccacaatttgctcaggttatataatatgcaaatgagtatttcagtactggttggatacaattttctgaattttcttgcaactctgaccaatggaggattataatttttttattagctcttttctcttaaggttgtaaaaatctagactggcttagcattcttattttggcctcatgatcacagtggaaagcattcatataagctaaaatgtccaattttataattgagaatcaaaaagatggaataacattaatatgttggaaggaaaataacccattaaccccattattccatcctcagttattctcattttcaacttaccttacatatcttaaatagctgtaaatactatttctgtactctgcttcttcatttaacatatcaatatttttctatttttggccaggcggcgtagcttgctcctgtaatacctgcaatttaggaggctgaggcaggcagatcgcctgaggccaggagttcaagaccagcctggccaaaatggcgcaaccctgtctctactaaaaatccaaaaattagccagagtggtggaacatgcctgtaatctcagcttcttgggaggctgaggcatgagaattgcttcaacccaggaggtggaggttacagtgagccaagatcgtgccactgcactccagcctgggtgacagagcaagactctgtctcaatttaaaaaaaaaaaaaatccatttttctaatacttatagctttcattttattgagtgtcttatgaaagagctctatcaagaattttacatatatattatttagttcttattacaatattgaaaagaaggagttgttaatcctaattttacaggtgagaaaatgattccgtgagatgaaataacttgagcaaggtcataggctggggtaacccaagtctgtctacctcaaagaacgtgctctggttcttcagcttgttgccttcctctactgtggatataattatctttttaatggccataaaagtgttcatgttgtgaatatttctagatgcattacagtatttggcagttttcttttcggaagtatggtagcctatgaaattcagggttgacgttgttggttgttgaaaaatagctttgtgaaagactgttggttgttgaaaaatagctttgtgaaaggctcttgcagcttgtagaccattatattctctactggtagcaaataaggtcctctggtctttataacagacaataaagaacaaaaggccaatgcctcacaattttgaatagattatctttccaattctattaccaagtttttctgttctctgcaagctctgtaaggcttcaggttggaaacaagtagtacatatcagattttgtatgacatctaagatcagctttgaaaaaaatatgcaatcttccttcctatttcttctatcttagaaacttgtaaatacgcaaacaaatggaattctcatattttctgcctgtgcaatatatattatgatttggtttaggtatgtgactactgtcaaagttggttcagggttttgagcatgaggtaaactttttttggtcctattacccaagttagtgatgtatctgttatgaaatatacttaaagatatacagcttttagaaatgattaagataccttgaaatatttgatgtatttaaaacataactagaaagacacagagtggatcacagataggtttactctttaaagtcatgaagtatgagattccctggaaaaagccatttgtccactgtacttctaacatgctctgtgtccctggaggagtcacctagtccctctgaagccaagtctactgtcctgtaaaataaaaggggcaaggcaggtcaatggattttaaacacgtttatttcaatgggacattttttattaatgaaatgtgagttgaagttaatataaatgaatatttatactgtaatttttagatataaaatcatatataaattcaatatatagatataatttttaaaaacatagatatgtgtgaaatatataagtaaaaagtataagcacacataaaacaataaaacagccactgagtttgtacatttaccccccaccccaaattcaaaccctctccttaaaatacctctaaagactttaggattccaaggaatattgtttgaaaaccactaagctaatgactgttaagatcacttacagttttactctctgcagtgctgccttaccgcgggagagtcatttgtgtattctgtatctctatatggattgggataaactcgtaggtaatgtagcagttcaaatacctctgccttataagaccttgaagttatgtaacttttcccacttctgagatatcacagaagagttatcactataatagttaagatctattcattttatttagcatcttattttttacaagtttattttaggctcatctggaatgagaaaatcatgcactaaacactgtatgatgcatagctgataattcaggaagtgagtatggttgttggtaaagaaatgctgaattggtatgaaattcttcagaagcaagacgcttcttttggtatttcaaaatggggttctccaccctctttttctatcatgtcaactggctgtggttatgtgtgcaataatacttagtcctgactgcaactcttttttttttcttccccacggatctgaggcacaccatggttttggccttatcattaaaacttgccttttaggagaggtaaaggaatagctcacttagtagttcctctgtcaatcattccaatcatgtagtgaattctattgaatcagaagggatgatgacatgaaggtaaccatgagtatacgaatggttagtcatggatccacccaaccattactagcaagattgagaaaagtagattctaagatgaaactgaaggggaagaatattaatgaggcctttaaggagtttttaagctttttagggaaagatgctgagcgatatgtataaatattcccaataatactaatactaaacatatagaattgtcaaagtttagataaaggtatagagaatagggcctgagggatattagctaggttggtaaggaagatagtcacaaagaaagcacagtcttaataaaaaatcaatatagattttcttggaagcctttccagaggtgatccaatatctcaaaatataatacaggggttgaaggtatattagaaaatggacagaagtaaggtatacttcagccacaagcaccaaatctctccagggattggtgcctatgggaagggctggggtaccacatggggcacaatgacagcaagcctgggtgagacactgttaaatataactgtgtacaggtaactaactaatgagagcccgtgccagtgatatgtctcagctctcaaattgcctagttctttgtcaagtttgacctaaattagaaagcatttcaaaagtatggaaagtaggaagaatgccagaacctatggatgcagttttttagcatgacaggggcaatattgtaagtatttattatctgtcctaagccttctaaggggattggctccctaatgagcatcctgggtgatggctgaggatgcgaattagagaagctaacagaagggtgaactgctcttcagaataagagttagaaaaacacaagggaatatttcaagagaagagctggggaagtgtggcaagaaaaaagagattatacagagaccaatatggaagaattccagcccagtttgaactaagcatccaccatctagcaccctaccctgtttaataacactggcaacctctgggcaaaagctgccattaatgaaactcagtgtagaggacatttgccccccatctcagccctaagaatttctgccatagggtaaagggggtcacctgcaagcccttccatttccctactacacatgaggaagaataagaaattagaaaactagaaactaggtgtagaatgtatgcacaccaaggattgcatcttccaaagtacccttataggaagcagtcctgttgttttaaacccacagagttaggaagttttctttatatctaatacaaatcttctttgcttaaattctaacccatttcctcttagttgtcagtagatataatgagagtgaatcaatagataaaccaattcttctttatggcctttgaaaactgctagtgagtgacttcttggtcttttttcatttcatattgcaaaatattcattctaaattgtaaaatagatggcaccagtgtgacttgttaaaataaatgtttcattaaacataatttcagtatgtaattgttttcagacttcctagagaaaagtgctcccgttgtatctaattctctttcttgtttaaaatacatcaaagatgagaaattgagctctttttagtgaacttgcttgagacattcatatggaatacagaaaataataattcctaacattcaggatgtcattccattgcaatgtggcacagagttttttctttgcatcaaggaatttatatgactgatactattttagtcaggataaattactgtaaaatgtgtccacttttaaccaatggcattctaacatgggataggcaacagcgggctgtgatttttgctctgatactgcaactttgttatagaatagcaagtaactgattggcagctagatcaccagctagctggagaaagcagcttctaggtctatagtcatagttggagtcataacctcattaatgatagctacaatgtattgggcatctactctttgacagacaatgaacttagtactatatacagttgaagcaactgtatgaataaactgtatgaataaaacttgaagtcgcacagcttataaaattacagtgctgcagaaaaatcttggtctgtcgaaactacatcccatatttgttgttgttgttcttattgttttgtttgcttttcctcactatctaaactgctttggctacacatagttctgtttcatggtattagaaaagtagtcaacaagctgctacttatacttttccttcctgtcctagactgttcaagtttcttcttttaatcttatgtatatcaagaacatgtttgcctatggtatttgtctgcctttccccccaagatttgtatacaagcctccaaccgtgagccctagagatatattgagaaatagaacatggactttgacacggctccattccttggagatctagctagttcctgactcgttcagcttattgactctcttcctctggtcagactataaattgcagttttccttctctctggcatttgaccagttagtagcaccataaaacctttgaaataaaagagaccacagagaataacctataatctgattttccccacccctaaccccaatgtggagctggaaacattttgctagtctttaacatttccagtcaagtagggtcaagaaaaactgttaaaaacaatgtcaatgcttaagtggtaaaaagatttgttgaagaatatatatatatatatatatttagagacagggtctcactgtgtttcccaggctgaggtacagtggctatttacaggtgtgatcatatgcactacagccttgaactcctagtctcaatcctcctgccttagccttcccagtaactgggactacaggcatacaccaccatgcctggctggagaaatatttttttaacttcaaaaatgaagtttgagctgaaaaagagagctaaaaattagtctgtcaggcaaatgtgtgaaagcagttctattataatttgtattgagctataatgtaattcctaaacttatgtcatatagctaagtaagtagctgtaattcgcatcttgaaattttaaatttacttctttcctctcaatatagtcttcatctgaattaaaaattgtggcaatttgtatttattgtgtacttaactatgtgccaggcactgtgctgttcacttgacctaattatctcattagatcctcatgatgaatcctagacagtactcattagtcttattcctcagactgaggcctaatgaagtaaagtggcttgcctaaatttgagtggcaaataagataatttcatgattcgcatattttcttaattataaaatgttacctttagcaatgatgtatatgttaatatgttcaatgagttgatctacctgaagtgcttagcacatggctggctccttgtgagtgaccaggaactgttagcttatattatgcatttttgaagtttacacattggtatgactttctaaataatcaagaactctaaatgtgaaagctgattcattttgtaagggtttcttttccataaggtagtcttttttaacacagtcagaattaagcatttatatagagctaggtattccagataaatcacgttaatagtgtgattcaaagaagacacactgctatctaggtgggtcaaagaagtaaactacttagtggaggtggcaaaataagaagtggtcagtgggaagctaaaccacctctgatttagttatttaaaactcaatgagaaccctctaaggaagcacaactaggcaggggtttcatctgaaaggaatggtcagctacctgagcattatctctaggtgcacctttgtaaagactttctccatgtatctttcctactgggtgccaccctgtggcttggtcctacggtaatcacactgccaggcattctctacctctacaaatcccttactcttctagtcctaaggtgcattcctggttgtgtaattcacagattattatctccctggagctgagcctcatcatctctatcagaccagactgagaaggactcctttttcctttgtcccgccatcccagctcagtgcagaaggcttaagatgctttctccatcatttctaaagaacaacagacaaaaatagagatctggttaggtctgttcttgtggcgtgaagtgttaggatgagctgaacagccacaggggctagaaatgtcaagaatgcaatacgttagagcaggcatttagcattcctgtctctgatatctactattttattatgagtagttaccaaaacaaaacaaaacaaactgtaaaagcattattttgttataattaacaactgcacattggattaagtgtgattgagggtggagttcaccagcttgggaaaaaaaattaaccattaaagattccctgagtgttttgctttaaaaagagatagcccaattacttttctgtgtttcgttaagagtctactagtatatgaatcagtaagagcttctagggtaatataaaacacacacaaaaaagcaaatttgatgttagcagacaactttttaaaggtattcgtgtaactgaaaaaatcattttacgtacataggaatgaaattttatgtttacctagaaatatatgtgaaatccctccattattgcaagatctttttcatgtaaatatcaaaagaattagacagtctgcattgtttaaaaccaagatagctagtctttttaatctatgggcaacttgtaattacgaatagcagtagctgcctggaataatgtactgagagctgcgttggtctcagagaaaatgtgctgtgatccattggtgatctctgccagacagaagagggacatagtgtggctgcttgccatttaaatggccttgatgatctcatcataactctatatatctaatctcaccattaaatttgcatgcaaataaagtcattgtagcagaaacaggttttatgcatacatacaaatacatgtgtattttttgatatgttttgtctatttgtcacctatgaagaacatataaatattgtaaacagaaaaactctttttggatgttgcaaatgcaaagaagaaaaataagtaattctaattttcaaaggtcacccctgtaatcaccacccagattaaaaatagtaccagcagccaaaagtcacctttatgcccctttaagcccctgcccccacctactaaaaataatagtgatcctgattttgaaaatcacaaactttttaaatttcctgcttttgaattttatataaaaggaataatatagcatgtactcttttgtgtttggctgtttccctcacccccttgcaaaattatgtttgaaagatgatcccttgttgatgcggatatggttcattcattctcacttaagtataggtaattaagcaaacttttgtttgagatacaaattcagggtaaaaatcagattttctatttaaataataatttggtatatatgactatttgagcattttaaactgttgtcattttacaataattattttagtatgatttaatatccaaattctgttgcttagattcaccctcagtggacatttcttctgaagggccttcctagacttccccaattagaattaaaactctcttctctgtgctgtcatgaaaccttgtacatttctctaactcttgaaggattacaattattgtcttctgtctcacgtacctctcctgtgagcatgttttggagtagactgggtttgctcatctttgtagagcaatgaacccctgttcccagcaccatgcctgctccatcatgggcattcaacatctgtcctttgcatggaaagtagaacagtgagttcttccatattacaaagaatattacagtcaatttttatttttaattttcttttagtagatggcacttttcaggagattgtactgggtgagttgtagacacagtagttactctttatggcaagagttgtatagtatccgggaggatttttgcctcttccctgtggctttctttcacccttagtttgccaccaccactggcaattctaatctaggcacaccttccattgcctcctgtgtttcccattctaaaatatatacttccaagttttcctctatattttctgactgctcgaatgactcttctcgtgtcataaactagtaaagagtagtgcatatagaaatgctgataaatgtgttgcacatggttatcacccgactgacatgctgaccttctgactctatcaatgggtgatttttatatgaagccaagaaatctgttggtggtaagtactaagaccaccacttcaggctcactctaacctcattgtgtgcatcttgaaaccccacacagttgtcacatatgagcagattccacaggagggatgctgaaccaaagtgacaagcttgtcctggagccctaacacagggattgacccccgaccttcaaagtcagggaacaacttagggttggcttaccttcttgtattgtgaacttttccgattgtgaagccagcttttagctttaccacactcccagacttaaatatttggaatggcaagaaattaggcttaaaaaaaaagaaggaaattaaggcttaatccttaataatgaggaagtaatttgttttagtattgtacagaaacattttctagctacctgatcatttagtctagttctatagcttaaaatatatagtccttaaagaaaagttttatttctgtgggtctattagttacaaaagtaaaggtgcattttttattgctttatttaagtgtttattaagcttgttctgccacaggtaccctgctggctgttagagagacaatggtgaaatatacagcactcggcttcataaaatttatggtctagtgactttctgaagtatttctatagggcaggagacttctatttcaccttctactatatccttggaatagtttttactttcctggtaggagtgtgcatttatataagtgtttcagttgcttccagaaatccagtggtaaacaacataattttaaaacctccctacttgaatttggggtggagtaatataaaataaatctggaatatttgattttttagaccaaaatactttccctgggttagagagatattttcttttcttactggcctggaaatccatgccattttaataagagatatttttattctaggtaaattgtttacttaatcacctcctaacaaggctgtgtcagccaagttaaatatttaaatttatttttatttaaataaattttaaaaccaacagatttctttctcattttaatgaatttagcctttgagttttcaaagataaaatatacagagtagaacattttaatgtatctgtagagagggaacacaaaaagggcacatcaggaaaaaatagttggaaaaaagtgaattttatacaaaattaactcataaaatgaatataaggcattatttcacttattgccaaaatctgtctttacagataatcttcgggagacctttatttttataggccctagttaaaatattttttgaatgcttgaggctctatttcactaataagagaaataaactttttctttctataaataactgctactagcttgtttgtcagctctctaaataaactcattttactattactatgcttgagtgctgttatatattcctttgttactgtgcataatccctggctataactgcattaataagtaaggccattacatcaaatagggatctaacaaaaactttcgaatggactatcaaagaccagattcaatgcaggaaatcagaaggaaatggcatttatgtcctagtgtagttcagttaaaaggcctgcccttaaggattacaactgccataaaagggcaccatgcaagaatggaaaacctgtttacaacaaaatatcaaattattatctgactttcacaatgaaccacattattctatgactgccagtcatacatctggactactataccatttgtgtgcagttacagcagctccagttctatatggctagttttgaacttagtctgactttaaaacccatcccatttactatcctctgctttttttttttttttggtgtatattgtgggaaattccataaatgatttttataaactttagccagtaatcgggaaaaactgtaagattttgtttgtaagctttataaacgttacttataagattttaattgaattctaaattaatttctaatttgaacctctcccttctcttagctttatatgcttggtcatccctccttaagtaattagcttttttgaagctttgttttttttggtttttcactgtttctgttatattgacgatttgactttcttataaattgttagtaatttcctgaataaagtacagaagtttatctttcaaatttcccatggatcatttcttaatagtcaaacaattgtctaaatttccaatacacaaagaaaagttttagctaacttacttcaataagatggataatttgttcaaagtgccaaacacatttgctttcgtaattcatgccatttgtgtgttaagtgtataaaagagatagagaaagaatataggaaatgtaactacacatgcaatcttgggctttccaaaatgtttaaagtaccaaattcccttggtgccaattgctttaggcatttcatcttcactcagttgcatcctaaatatagcgtaggtgtgacataccctgtaaatttcaaattcacataaagaagtcccagccttcgaggcaagtcttaattgaatactaaataaaaaccttagtgtcttctgaaatgtttctgaataaatagttgctttacagtctttgatttctatgttcgttagtgtccaaattcagaatgggaaccaacttggggagaaaaagaaaaaaagactctcaggacaatctttttaaaggagtaacagataatctattttggctaagacagggtagattcaggtagtcagataatagaaaggggagtcccttgtgtatcaactgatgctggaatttgtgaaatcctataaagttttgtagaaaaaaatgttaaattcatggaaacttgtttggtcataatcctcacagtttctaatttagtataacatcctgaataaattcattcagaccgacggagagaagaaattattatttgcaatatgtgaatttctgactaataggagtaatagaaaataattggtcccttaggatatttctgattatatatgagaggcttggggagggactctgtgtaaccgttgcttttaacccttgtttttgatgggtaaatagaacattaatgctacatgaaagatacttactctggcatcctcaagagaaagtaggttcttttttttctcagttatccaagaaacttttaacaattctaaagaaagaaataaaaagcacttagttttcagaagcatgtttcagcttcttgcatcaggagtaggccagatggccatgttctgtatggctttataaatattcctttttgttccatgtaaaagttaatggctagttttaaaccttggtatcatttcgaagtcagaccttatgtgcttaacttcattcaaagtatttctattttgttaggctgtaggaaaacatagagctgagctattaaaattccagggcagtttggaattgccaacaatatgtactggagagatgggggtggattctgaagtcaaatgaatttggaactcatcttcttttacatgctgggtgattttggacaagggggaaaagctacccatagggtttctgtgaatgttaagtgaaataatacatggaaagtgcttgaagtaatggtagggacacagcaaaccaaaaaaaatgctagccagtttattattagaagggaaaaactcctattaatattttcttgtttatgtttgtgttttcatgttagtcttaaaacaagttactgtttgagaatgtgagaattttaaccatttacaaaatggtgtatgatatgacatgtatatgatctctcacaagtgaaatgataatggaaagtttactgaaaatgtcttaacagttctaggtaaaacttaatttttccttaatttgaaaattaataaaagtatgaattagatttaatctaaatttattattctgttaaagtcacatgaatgtggaaaaaaatcagtatcacttctaactaaatctggccttgaaacttctttgacatagtcttcttaaaatatatatatcttatattctaaattgtatattatttagaaatatgctatttctaaactgaaatgtctgatatttctaactgatatatatatctatatatgatatgatatatgattatatatatgttatctatatgatatataatatatgatatatatttctaactgatataacaatgtatctcagttcttagagatatgtaaattatattttaatagtagcctacaaagatgatacaagaagataagaaataaatatacttttatatataaaatagttcaacagcaagattcttatttagaataattttctacagttttatttagggtagtttctatacagaaaaaatacatattttatctcctttctgtgctaggctctggagatgcaatggtgcctccctcccttcctggagcttaccaagcaaaacaaattcactaaataaaattattcctaattgtgttttaagtccagtgaagagaacacaggagggaccgagttaaacagtgtgtttgtgtatgtctgtgtatgggtgtgtgtctgtgtctgtgtgtctctttgtggctgtgtgtcctagagatgtactttagttggagtggtcagggaagttgagaactgaaagaaccagtcaaacaaacattggggagaaggggattatagcaggtacaaaggtcttgaatatccagcagatatgaggagcagaaaggctatctttttcaatcacttaaaaaggaaaagaagtgaaagattgctgtcttaagaacttaaatttatatggcactcatgtatagatttccagtgaaaagttggacaacgtgaaatgatgggtttcctacctacaagtctccagtgtttgtctttgactggggtgttttctgtacatatctgacctgatttctgttgctagcctgtcttcccaggggccttggtgagccgaggtcagagagagtggacttcacctaggaaaaaaggaaaggcttctgacataaaagtgcccttgaaaatgttctgctgctgtaaatcccttctctttacacaaagtttaagaccctcccaagagtttgacttgctaaactacaagagcatttttattaggtgtaagatctcactttgactttaagtagcaagtgacacaccaggcaaccctcgctgaattctctcttgccataagtgcatagatttcagtgttctaatgcctctctgagctaaatttgcctctgatctgagttctaaatgtaattggatagtagatatatgtgagtaaaaaaaaattctaccaaatggttggaatagttttcccaaagaatgtaatattggccttcagctggtaataggatgtgcctgctggatgaatgacatggttgatgcaaaagacagatgtaagccgtggttccccaaactgcagtagggatgagcatgacagccacacatatcaaaggccaggtactgatattcttactggaaagactgctcaggatgtatgtggtgttctttttcctggccacccttaaggagtttatgaatgggttccatcagcttcaaacagcaaacacagtttggcctgtatgaactgaaacccatcacacatcattgccacgatcattttcctcatgtatgcaagttctcaagtatatttttggtcacaaaacagcaaaatcatgacaaaagcaacaataacaaccaaaagtaactaaatacgatttttatttagtatgaaatgtattgcattgtaattatttcaacatcataacatttattaaagatgtatgtatcactttattattctatgctcatcccccctctttatacaaaatggagcataatctgcacattcattgttctgcagtttgtattttgcacttgacagtatgttgatacaaagagaagctacttgtgttgctctggaagaactttattgagatataactcgtatgccatacttttcatctatagaggttatataatgtattgatttttagtatatttacgtagttgttagttaatatctaccattctttgaccataatgaataacagggttttctctgcacagatatgtccatttaagtaaagatgccaatgcagctaaatagaatcactcaaaaacaactccaaaatgagccagggagagtggagggaaggaaaaggaggaatgcatccaaacatagccctacgttccatgaacactcagtaacatcatcaaaacgtgatgcaattaaattttaccaggtttactgctgtcctgatgctttccaattttttttgacaacagttttgcctttttcaaattcaaatggtataattggggcttggtagttgatgtttatcttaattgaaacagattctcttcatccttttgctctgagactcccactttgaggctgaaaggtcattttaaatctgcagagcactcgagaagccacataatgaattcaaacaaattcatgcctattaaaaggaggcttctctttctcaacttccagagcttacatagaataaaccatttggtttttgtctgactttcttttaaaaggaagttattgtgcttcctttttaatgctctaactacagagaatggggaaatcctgttttcatttattcttatcagaaagaaagtgtattttgctcagtaattgcaataaaatactactggggttacagctactatacttgtcaacaaatttaagggatattctttagctgcattactttaaggatttcttgtctatcttttatctagcaacttcattttttaacatttactctatgtacttgtgtaaaggtgcaaaaaatatatgtacaaaaatgttctgctggagtttttgtaacagaacactggagaaagcctaaatgtcaatcggtatatggctgattgaacaactgatgcacaactataagacaatactgtgcatctatgaggaagacctctctagtatgacactatctccagatgacatttactattgtattatttttatactttgaaaagaagatatgcacactcccatgtatccattttcactagttttctttgtatatactcttagagtttatgtaagtgcaatgaaaacataaattctattctcttcctccctttttaaacaaaaagaagtataatctgcacattcattgttctgcagtttgtattttgcacttgacagtgtgtcaatacatagagaagcttcttgtgttgttctggaagacctttgttgagatataactcacataccctactcttcatcaatacagggtgtataatttcgtgatttttagtatattcacacacttttgcaaccgtcaccaaaatcaatgtagaacattttactaccactataagaaaccccttaccttatagttatcaccctccatctcccccattacctgctccatatcacctgcctcccttccaccccacagctctaggcaacggctaatctacgtttttttcctctataatttgcctactctgaatgtttcatataaatggaattatataatatgaggtcttttgtgacttgcttctttcacttagcataatgttttcaagtctcattcatgttgtagcatatatcagatttcattttttaggaccgaataatattccattatatgaatataccacattttgcttatttattcatcagttgatagacacttgcgttgtttcactttttggctattttgaaatgtgctgcaatgaacatttatgcaaaagattttgtgtgtgcatatattttcctttcttctgggtatattcctagtagtggaattgctgggacaaatggtagctctaagtttaaccttttggttattttccagtgtatctgcattctcatgtttcttacagcagaaagttattctcttgaatggctgcatcattattgatgtagtcaaggtgtatttttaagtggaaaagttaaggcacaatgttcccagttatggaaaaatatgctaagactgtacatacataaatatgtttcactcaaaagcatctttctgcgtatgcacttaaggtgatggtagaagttgctagctttgaggaagaggtggctacacgtttggaatctgaggtagaagggggctgagtactcaccattttaaacttggggaaattttactatgtgtgctaattaatttttcaattgaaaatttgattcattaatgtaaagaagaagaaatgtaaaaaataaaaaagaagaagaagaagaaatgtattttcctggactcctctgaccaatgttggtcaggccaggggcttcttgacctgtgctttgtttgagtcatccggcaccatgaggtgcttagtgctgtacaagcactcttcttgccatctgctctgcttgacatcatttttagttattaggacaaaaaattaatgactgcttttctatctttaagccaagacaccatttaaaaaacagacatttagctcttactctaaattagtgtttcttaaatgttttattcaaatcaatccacatcaaaagcaaaataggagggaaaactagggtagacatctgagtgaaccttgggattgagaaataggagggtggtatgtgaactaatcattaatggtattagcaaatagagctgggcagtctgtctgaagtgcttcccagttttttgtacattcttctccaagtatcatgtgttggtgactggaagagggagtctttactttccgcacagtttccatcatgtagctctggaagggctttgtgtttgttctcatctttgcttgagaatcagctgtcttattttgggcttttctattttttaagacaaaacctacctatagtggttatacatgaaacacaccagtagatttgatttctgcctttggttaaattagtttgccttattaaatgataggaaagaatcaaaattcgtttgccttatagatttgttcattcttatattcactcatgtattcattaagcatttatttattcaacactcctatgacatcactcctcactgagtgatgattccttctagggtgccatagagggcttgatttccagctggaggaagaataatttaatatcctttttaatgatcaaaattctaaccaaacccaattttgaaaaataacttgactttgcctaaaagtacattaagaaagatatagaaaagagattctatgaaaatgaaatttaataatgtaaaataatttggttttatcagaaattcataaacagactttacttagagttaaaagtccctttgagaggagtaaaatcattaatgaaaaaaatgcatacattttcttcaatcatcatctatatcccatcgtgataatgaggagtacgctgtgtgtagtgactgtgtttgcaggtggagggagtttgagtaatggaagtaataaagatgctcccagaacaagtaccgcatccaattagcttgccaattaacaatctattcctgaagtatttgtttatgaagatgattttaactagagagaagtcatattttattttgtttatatataaagatatgttaatcataaaatgtattcctttcaaacagttatacatttttcctttggcagcactattgtttattttaaaggaaaagacagtaactaatcacagcatttttaaagaaacaaatagagattatgctgctgtaaagccagcataaagccatttttccaaatgtcaacagagttaacaaagaattttatgttgtaaaaacctcacagttgcctagtttactccctcatcaaaaaaagagggggcaagattctttgacatttttatgtataatgtgactagagaatgtgacttcagtgatgatgatgatctaattgcaatgctaagaaccatggctgggctacgactgtgtgtgcacgttgttatgctggggagcaagggtacctaggaaagaaagcaataatgaaagtatcacttgggtatttgtttatttctggatcttattctatctgctccatattatcactttggcatttaaaatctagatgatggctgggtgggtgcagtagctcacacctataatcctaacactctgggaggccgaggtgggaggatcacttgagtccaggaatgtaagaccagcctgggcaacataggaagaccctgtctctacaaaaaaatatttttaaaaattctccaggcgtggttgcacacacctgtagtcccacctactcgagaggctgaggtgggaggattgcttgagactgggaggtcaaggctgcagtgagctgtgattgtgccactacactccagcctgggtgacagcaagaccccatctcggggaaaaaaaaaacccagatgatatggttaaccatattcagtcattattcagttattagaaaataagatttacaaggcatccatggaggggaaaacaattacacacctggttagttgggctgaggcttgcagagataaaatcacctgcacactgttgcagagccagtgctccaacctagacttccggacaccaaagcctatggccattaagcactctgctggactgtatcttggatagtttgctttatggggaacgtagtacaactttacaatacaactttaaaaataaagtatagcagagtagcagtttgtccacagtcaaatatgaaatatgtaaacatttcacaggttctttttttaatttttattttaggtttgggggtacatgtgaaggtttgttatatgggtagactcatgtcacaggggttggttgtacatattatttcatcacccgggtattaagcccaaagcctaatagttatcttttctgctcctctccttcttcccaccctccctgatcaagtagaccccaatgtctgttgtttccttctttgtgtgcctgagttctcatcatttagctcccacttataagtgagaacatgcagtatttggttttctgtttctgtgttaatttgctaaggataatagcctccaggtctatccatgttaaaagacatgatctcattcttttttatggctgcatggtattccttggtgtaaatttacctcattctctttgtctaatctgtgactgatgggtatctaggttgattccatgtcgttactattgttaatagtgctggaatgaacattcgtttgcctgtatctttatggtagaatgatttatattcctctgggaatatgcccagtaataggattgcatggtcaaacggtagttctgctcttagctctttgaggaattgccacactgctttccacaatggttgaactaatttacactcccaccaaaagtttgtaagtgttcccttttctctacaaccttgctagcatctgttattttttgtctttttaataatagccattatgactggtatgagatggtatcttgtggttttgatttgcatttctctaataatcagtgttattaagggttttttcatatgcttgttggccgcatgtatgtcttcttttgaaaagtgtctgttcatgtcttttgcccaccttttaatggggttgtttgttttcctcttctaaatttgtttaagttccttatagatgcaggatatttgacctttgccagatatatagtttgcaaatattttctcccattctgtaggttgtctgtttaactctgttgatagtttctttggctgtgcagaagcttttaagtttatttagatcccacttgtcaatttttgcttttattgtgattgcttttggtgtctttgtcatgaatctttgcctgctgctatgttcaggatgggattgcctaggtcatcttccagggtttctatagttttgggttttatatttaagtctttaatccatcttgaatttttttgtgtgtatggtgaaaggaaggggtccagcttcaatcttctgcatatgggtagccagttatcccagcaccatttattgaatagggagtgttttctccattgcttttctttagctttgtcgaagatcagatggtcctaggtgtgcagttttatttctgagctctctattctgatccattggtctatctggctgttcttgtaccagtaccatgctgttatggttactgtatccttgtattatagtttgaagttgggcaaggtgatgcctccagctttgttattttttattagaattgccttggctattcgggctctttttggttccatatgaattttaaaaagttttttctagttctgtatttcacagcttctaactacattctattgttggacatctttatattttatccaaataggaaaacattaatttaaaattcttgtcatataatctacaaaatatttatattcaaggcacaatgacccttacatattctttttttcttttctttctttctttttttttttttcgaggcaggatcttgctctgttacccaagctggagtgcagtagctcaatcacagctcattgcagctttgacctcccatgcttaagcgatactcccacctcaacctcatgagtagctgcaacaacaggcgtgccccaccactcctggcttgttttttttaattttttttgtttttttttttgtagagacagtgtctccctatgttgcccaagctggattcaaacaatctgcctgcctcagcctcccaaagtgcttggattacaggtatgaaccaccatgcccagcccttaaaatagtttttattataaaggcaatttatgtgcattctaggtttctttaaaaacctagcaagaggccaggcatggtggaatgccagaaatcccagcactttgggaggccaaagtgagaggactgcttgaagcctagaaatagagaccagcctggcaacaaagcaaggccctgtctctacaaaaaataaaaaataaaaattatttttttatggtgtgtccctgtagtaccagctctcaagaggctgaggtgggaggattgtgttcagggtgcagtgagccatgattgcaccactgcactccaccctgggtgatggaacaagactcttaaacatacacacacacatatacacacacacacaatacgacacacgtatagaaaaaataaaaatacaaatataaatttctcataacctcaacacactcccaaataatcactgctaattcttagttattttcttctattctttttccaagcaagtatgatactaatagcaattacctggattgtacagttttaatttctttttttaatttagcattttatcatgagcatttttccatatcacttaacattatttcaaacattacttatatggatacaaaatgtttcaccctaaaaagattttgtaacttatgtatttgccaattattggatattcaggctgtttctagcttttcccaattattaaaattatcagcaaggaacatctttgaactgaaacattggcttatctctgaatatttccttagtaaaataactatgtcaaagaatatgactattttaagactattaatatatgttgcaaaaaatacttctctaaaggttataccaggttacactccaagccacactgcttgagagttctcatcttactgtgctgctgcaggaaatgtttttcattaaaaaaaatctttatccacatattaggttaaagtggtatttcagtgttgttttacttaacacttttggactactggtgtgaataaaaatggttttaatatttttattagccatttatcttctgttaattttctgtttgtctcttcgcttattttctattggggttgcatagttttttactttttgcaagagttctttatgtattagatagatgaaccttctccagctcacatttattgtaattatatattccaatttttagtcccctttttacttttgttcatggtgttttatacagtcaaatttattgattttttttcttttgtaacttctttctttgctttaataatttgagggcttttatcttaagagtagataaatgtttagctacattttccgtatttgtgattttttaacctagctcttaatctgtttggaatttatcttaatataaggtagggatacaagtttattttttcccactatacgtctcaggaccatttgttacatgtgccctactttgcttattgctttgtgtcacagataaaattttatgtatcatctatcatgtgtagacacctcagatataaattacattttacaaataacatctcaatagaaacaagtagaaaaaaaagaactctggtgcaacccattgagagaaacatactacattacaactataacaatgatgtaactaaatttctatttgccttctaaacctttttattgcttgtagccatttgctaactcctgaagaaacttttaccttttcttgtcccagggagttgattatttaattacagtagcataagacaaaatgataaggattggaatccgcaatgagccctttcactgggatgaagcagaggctgatgggactgggtggtaggtgggtaaggtggcagatagatgcaagagcaggaaccactcaccaggcactaggaaaagctccatctagccaggcatattggcaatagtgtgccctgactagtctttgggggcaaaacataacagtctcctaaaaagtggctcagaacaggtaattcctagacatatgcccaggcgtgaacaggacaacttattgaggtatggaaataaaatcttatattttttcttatccgctcacaaattttctttttcttgtattttgtaaaatagataatattttgacataatagtgcaagaacataacttattgaaaataaatatacgtaatggaggtgcttgcacttttttttttttttttttttttttttttactaatagatacggtatccaataaaattggtaatcacttgtctggatcatgtgacttcaggaagctctatacaccagcttgcagttcatggatgggacaggaagagagtatcttaagcctatgttggaaggccaggtggactggagtctcagggacggaagataagcacagggaattaaagcagaagccagtagtaatcagagataagacgtatgttcaagttaactgcagcaggatggtgtggtgctgggctcctgaatctgtttctgcctaaagtcatatctgtaaagatcaaggaggaggagccagagcagcaggtgaggttcaagtgattaataacactggaaaggagaacaggttgcagaaactatggctcaggctacctattcagccattttcattttttgtaatgcaagtgcctattacataatcaagggtatccttagtaacatatgaagcctacattctatttccatttttaaaaagttcaccagtaaacaattgtacagcaaattttatcaatgtaaaaagccattgtactctatccagtcaaaccatattcacctctcctaaagtgcccattacggaggctctgggaaattgaagttgcccttaatcttgagttacaatgggcagggcctctttttttctctaaattttactcaataaatgcaggcttcctatgcattaaatggtgcccacaaacattgaaactactagctcacctcctgaaattcagcactttactatgtgtctttcaatgtaagagcattcactaatttaacaagcattacataacatgtgtcattaatgagttcagttagctaggccatggaatagatattcctgtaaatcaactcctttacagttactaactgacttagtttcatggcagaggcatttatttcaattagactgtggttcctgttgagataaaatgagatcaactatgtgacatgattttgaaaaccatattatattggtgcatgaatgtatatgtgtgtgggtgtaggtagtttacagacagaatgtgtaacataggcatgtggcttgtaactgaaacttttacaaaacctagttcattctcattctataaaagtgtgtacacacatgtgcatatacacacacacactgtgataatgtatctgtgtatttgagggttataaatatttagttgtagagttctgacaaagtagtaaaatagtctcacttcatctggataaagatcaccatctggaactataaaaattgcaatgattccaaattgttgaatagttggattgcatatttacttttcagtagtatgttggcatgcatgtagatccagccttcctttcaacaaagaacagtggtggaagattcccttaaatggttactctttcctcaataagagcaaccatataaaaattatagaactattagtcatcatagttgaaagtatcgcataagattaacagagtccccatctggtgatatgtttttacatcagatttattaagatcagagcgggttttaactagagcaatgacactgctattattaaataagagacggaaggcctaatacataattgtctatttctttctagacatttatgtgtttttattaggataatgaatacagaattatcaacatcatgatcatagtttttttggtttttaagtagtatctgtaatggcaagctcatttttattttataacctacccacacacagacctacagtgaagcaaaacagatgctgaaatatgtttgttgccattggctttgaagaaacctcagagaggtttgcctcagtattttaaaagcaaaatggttggtacctttctgaatagatgtcattgtgtccttcaaacaaagctgacactgtagaaaagaaatggattgccttgtctttttaccagtgaacatcttcacctgaacaaaactcatcaggaaaaataaaggattttcgaagtgtagttgttgtttaagcagatactagttattccatccttacaaatattttatatataatatatacatttatatataatatttatatgtatatttcatcacacaccaacatccacagacacacacacacacttgtttgactacttcctctattccttgaaacgcttttgagagacctgaaatatccttgtatggcaagaggggaatggaatcaagctgatttttccatttttacaatgtgcctgggattgtgctttgcagtttagtggcattttctgattcaacctcacagagccctgcatggtataatattgtctacatttaagatgagaaaagcaagatgtggagaggctaggaaatcttcccaaaggcacgaagctcctggcagaaccaggatttgaggccaagtatcaaggttacagtacagatagacatacatacactcaattataagtaaagtttttatgaggctgggtttgacagcaacatgataagtagaagtttttgatttggtaagatttttcgaaaactcagagagtttattgccaaatttatttttctcctagaaacatttttgttgttgttgttgctggcatggacagttataaaaataaattagaagtaaacagataacagtttcctggctgccttcatgtctgtgagcctaacacggctcccagaaggaaaaaatatgcctcaaggaggcttatatgatattgcttatttagggaacctttgaccacttatttacaatatccagttacagctgtgctactttcctttttgggcaaaagcacatattcgcttgaccattattttggaggaagctgatattgcctgtcacttccaacatgtccttgtgtaccctagctcataattgcagcatttaagcttggagctcccctaacaacacaattattgccaaatttaccatcgttgggaacattggtgaggcctgcttcagaggcctctttgtcagcaagaagcatgttgcagatatgcttcaccttgcatcataaatgcatttctaaaagtagtttcctattgaattattttgtaataacatgtttttctaactacaaaataaacacatgttcattgtggacaaattgggaacttcagaaaattcccaataaatattccaatatttattaatattttataaaatacacataacctgtcattgcagcttccagggatagccatcattaaaacgtgttggtttatttcctgaataaacctttaaagcatatacacacataccccacaaacatgctcacacacacacatatatatatatatatacatttttatggtcatatatatcctattatgtgccagatgaaatcaggtcggtctctctatacacacacacacacacacacacacacacacacacacacacacagacacacacacatacatacatatatctatacatatatatgtatatatgtaaatgtacatacatgtatgtgtatatatgtgtatatatgtatatatatatgtgtatacatatgtgtgtacacgtatacatatatgtgtgtatatagagagagagacctacctgatattcatctggcacataataggatatatatgaccattaaaatgtatgtatatgtatatatatatatgtgtgtgtatacatatattatttccaaattttgaaaatttttatttattattttttgagatgaagtcgccctatcgcccaggctggagtgcagtggcacaatcttggctcactgaaacctacgtctcctgggttcaagtgattcttgtacctcagcctcctgagtagctgggattttagttttgccccaccacacccaactaatttttgaatttttagtggagacagggtgtcaccatgttgcccagggtggtcttgaactcctgaagtgctgggattacaagcatgagccaacatgcccagcctgtatatatatataattttttattctgcattcttcgcttgacatttttaagaagtattttctcgtgtcatttaggattctagaaaaatctgatattctaatggtgacataggaatccattttacatgtaataaaatgatttattcaatatttagccattctttcattgttgggcattttaaattttcctcttttttctttattgtagtggttcactaagcatctttgtagaagaaatgttaatctgtatctctggttaattactttggcaaaatttttggaaatgctattactgggtcaaagagtttaaatggtgtctaaacttgtcaagacatactaaatatacttccagatagtttttacaacaaattttaagcctacatataaaaaaacagttccggtggctcacgcctgtaattccagcactttgggaggctgaggcaggcagatcacctgaggtcaggagttcgagaccagcctggccaatatggagaaaccccatctctactaaaaatacaaaaatcagctgggcatggcggtgggcacctgtaatcccagctactcaggagactgaggcaggagaatcacttgaacctgggaagcagaggttgcagtgagccaagatcactccactgcactccagcctgggcaacaagagagaaactccgtctcaaaaaaaaaaaaaaaaaaaaaaaaaaaaggttattttaagaaattgtatagtgaattctcttttttaaaaaagggaaaacatttatatatttattaatatttaaacctgcagttttataaaattttgtctagtccgacactcttgttttacaaatgggaaattgaggccccagttccatatgagagacaaatacaaaaatctgccttctaaagctggtcaaaagcagttatatctctatgatcaattcagaagttgagtcctctgttgaaatgatttcaatagttgaggtgattttactgtttctctttaatgttgtgatatattttctctcttatacgactctatagtaaaaacgagaatcattttactcaatctggttcatgtagcagtatcaggctgtgaaattcatactgctcagacactggttctccaactgtgatgtacgtaagaaatactgtgcctgctgtctcttaaatgtagagtcctgatcttcatccctaagaccctgattcatttgctttagataacactgagagctaatcatttttagcaagcatcccaggtaattctaaggccatattgtgagaaaagccagtataacgatggagaattcttatgttgatgctctgacactggctctacatctgtccataatttatttaactcctctctgcctcagtttccttatctataaaggaggaaaggaaatgccagtctcttccacctgggattcttgtgagattaaatgaaataagccatgcaaatgatttaacacagtctacagcacacagtaaatactcaataaatgtgaactcattatcgttactgttgtcattggtattcatattgatatcattattcctgcattggaaaatgtaaatgtacaattttaagtgattagcattgctggtggattattgattgcaatttgtcctgctgtctcttctgacattgctaaatttcatttacttaaatatttcccttatttttctcttgttcccacccatgcaccccagtggagttgaaattgagttgagatcaaatgcagcaggtgttgctcagagaatttggtaagactagttgaaaaaagatcagtgaaactttatcaaaaatagaatagtgattctcctggtcacctgcttagagaacccattaagaagtgtgaggttctccaggccaccatagagctataatctgcaccttgtatcagccatagcaggtatttgcacagtaaatttcccctcacctagtttattcataggtctgatcatagcacactacagactcaaactcctgggctcaagtgatcctccaatgtcagcttcttgagtagctgggactacatgtgtgggccaccatgcctgaccatggagttcttaaaaatggatattgacatacatatatagaaaattcattcaataaatagttatcactttcctatacctggtgtgagaattatgctagatattggaaatacagaaatgaatatattaatattaaagtcacttaactaagcttttccctgtgataatctttctgaaacaaagcaaaatgatacagaattctttaagtactattcaatttgtggctatttcctcctaaagatcagtgtatctgaacttgctggctgctagatattttagtcatttcaaaatgtactgatttggctaaagaatctactttgaccaaaataggataccttaaaatacaacatcagcaaaatatgtgtaaaatccccagagaaaagccctcttaaatgcctacttatttcaagtcaaatttagttaaactacataacttagtcccctgagtgtcagtggaatttctcccagagctgtgacttcgtcaagtaaagttaccctctctcttgacctttggaaagagatggcatttgttgatagttttgtgtgtgtccttaagctgggcgcttaacaaatattctctctaacaaatattctctcattaaaacctgaaacagccttttcttacacctagaactttgtaaagaatatgtcaggaataggacaatcaccttttaaggctcagacagccaagaagctgttttctttttcagtcaagtgtagagagcatccatgactgccaagttctcagccatggctggtacaggcgggtgcagtaggaggcacagttgccactcctcagaaagaacagggacatggctggacccattgtcctacttgctcagggccaggcagggtagcagacctagttgttgaatgcccttttattgatagttatttaacttcaataggatcttgtttttatggtaggcagatggtccttaattggtttgaactttgtcctcttttcatagcagaaattcttaatctgctgcccacaaataagctttggagatctgtaactcccttaaaataacaaaaatgtacaaagcatttagtaagtgtcatacagtgtgctgagcacttcacatgctttatctcctttaaatctcataaagactcatcacataggtactgttttcattcccatttttaaaatgaaatttaaagagactaaatgacttgaagaaggtcacaaaactaaatagcagtagggtcattattttaggccaggttatctaactccaaagcccttagcttaatcactaggctatactgaactttatggaattacatccaaaagggatgtgtgtgtgtgtgtgtgtgtgtgtgtgtttgtgaatttttccgaagactcacatttccaaagatttataagtcatgtcgttctcaaaggggtctctggtctccaaaatttgaaactctttgcaacagggtggctatgttttagaatgacataaacagatacaatgttctccagagtccagagcagggtctaaacctattgggatactatacttgtgttatcaactgaaccacttggttagttcactaggaagatctgcaggtcttgagctgagcttagtgttttacagacatgtgccattcattcatcacctacaccactcatcaaatatctgaagaactatgaaggctgaaggaaaataagtgggtgagcacaggtgcaaataaataataaatttggagcattctatttcgtgttatttcttgctaaaactggcatattaccccaaacatcaattgcaatatgctattcaacaagagtttttaactagtttataataggaaaattgctcttttttaaaaaccagggttaaagtcacatcctttctctcctctgacaaagtcactgtcacataaaataatggtcctagagtcaaaataataacagaactttgttctgatggagactgtaaatataccaatactcccattaaaaatataggtgggctgcctgaactgagaaggttgtgtcatggctgttagttttaataactggaaggcttgacagagataattgcgttagtgcttcactggcctcaagatgcatgcaatgagtaaaattaagaccatcttattaaaataccaaagcattgtataggaaactcccatgtattcaaaggggaaagaagaaaaaggaatttcatatttacggagcatgtactattttcaaaactctgttctaggtgctttcacattcattaactcattttaatatgtgagtgctttgtaatcctttttgagtgttgcaggctcagagagggtaagaagctttgcttaaggtcccctagctggcaagtaacagaacctattcaaattcagatctgatttcaaagtgcatgtagtttttgccacagtacgatgcttggggagctaaatggcatttgggaacctagagttaaagcatcagtattttttactaaggggccattggatcctagagaggcaacgaattataatggataaaaatacaaatttcaggcaagttacttctcttagcaccattgctttatccggcatagtaataaaaatcaaatgagacaatggatatgaaatgctaaaaatagtacattctctgttgttattatctattgtgattattgtgttacccttggaaaaaggcctgtagaatagtggcagctgggtcccctggacagtgaactaccaacctaaaaactgtctgggcaggcttgcctttgggagttcttgtatatcagctctaattctgtccaggaattcagaggcagagagcagggttgaggagaatttcacaggtggtaagatctccggtgaggaggcatttcagcaacgtgatcagtgttgccaaagctatgaaagatgttgaagaacacactttctacctgagatatcaactaaagtttgaagcttcaggagaaggcatagttctatcaacagacagcagtacagcaccaatagttaaaccctatatggtagatttaaatgctgagccttcaaaatcatttgcctgttttactttagctccagcaaagggatagagaaacccttcttctgtcatccctctcccatgtttgctgttgcttaagcagtatttattttggtaacaagaatacctggccttgccacttaatctccaccattccaaagaaaacctttctgagatcatcttaacgttgtctctaggcaataaatatctctggtttctagttattcccaaggacactgacctcacatttcttactgtcttaaagtcaaaagtacctttgtccttaactcacaccaatatgtatgagactaggatatgagagagattgttacatcttgcttgatgttttgacattataggtagtgtaggttttgttattacagtttgacttttgaaatgcgtatgagatttctcaggtgaaatagagcctttgatgtggtactcaaaagggataactatgactcagaggaaccatttctaaaagatggcactctttctccttccagttctttctgttcaatagtagggctggggaaaggcagaggcagtttttgttatttcaaatgacagcatcaaagatagtaatccacggtgctcaacaaaagtcgaatgaccttttttccttctccattcataaatacataagagctgatgcttcattatgtttaaatacaaaatgcacactcctactttgttttcctatatgtgagttctcatgtattcttcaaatgctcatctaattactgttacctactattccaaatgcaaatgacaaggtcccagtttactgttgatcctatattacaagagtcatcaattttggttgagaaacacaaaggacaaatatctcattattgtgctaaccatgcctattattagttttgtgcccccataacataagtaatagccccaaatacatggcacttatcacacaccaggcataattctaaatggcatgttctccatgttatggaagaagagactgaggcatggagagagtgagtaacttggccaaactcacaaggctacaaaggcagagaatcaggttttgaactcagggctgcctagaccctgtgttcttaactatcatcatatagtgtctctcttactgtttctcactgaagatgagagaggattaaaatctcaggaataaatgtaacctccacaggtaggcttatgcataaaattcagatgcaatgaataacaaaatgactgcctcccacaaaattaagaagcaaacatataatgaggacttactctgtgcacacactggtgaggacacgttacacatttcatatcactgagttcacacacacacacacacacacacacacacacacacacacctatatgagggcagtatgatttccccatgtgataaagaaggaaagggaagctcagacagattagatatattgtctgacattgttcagatagcaagaagcagattcaagatgcaagcatagaccagagaccattatttgagaccatgaggccttttctcaccagttattcattcacttaatattaatcacttaatatgcatttgctgagcacctgtcgatgtcttgtaaatcagtgcaggaaaatcataagatttgaaatcacagcatctaggttcatatctcagcttcatcattaaccagcaaaccagtaaacctccctgtttgcagtttcattatcaataaaatgggttgacaaaaaatttatttaacagaaatgttatgaaatgcaaataaaataatggatgtaaagaaattggcaaatggtcaagcaaaacatgaatgttaattttatgatgattaaagtaaatggtatggagacccccaacctcaaatagctgggaaggggtagttgataaggggagaaatgtgtttaaagccagttgctttattattttaaccctgagataatgctttattgacagtgtgaataagatgtttggaattgtggaaggaagaactggaggtcatattacacatttcttactacatgttgagctttgaaaagtgagaatgatttcatgaggcagaaattggttgggtctaaaacttcattatctgtaacacatactccagagagtgagaacagtatgaccagaagtatctttggaggggctagagacaagatttgaagggaattaggacaagattttaaagtaacctaagtgccgtgataaagaatccacttttataggcaaaagtagttattcaaggaagtaaaataattacattttctagccactgcaagctatctctttttccttccttttcttccttcattccttcttcctttcttcctgcctttctttccttccttccttctctccctctctccttttttcccttctttctccatcccgtttaaccacacacaaaatcccaacagcagcgtagaaagtggtgttgaagagctgggcatgtgggcagggacaccaccaaggaaggtggtgtaatatagcctggtgacgacagctttggctcttctcaccactcccgctcccgagtaagcacagcatagaggaatatgagctgagttcagtgctgtccagttggaattgggaatgttaaagctagaaggtcagcaagtccggtgttctcaacctgacaacacatcaaatagctatgacagccttttgaaaatagagattcctggatccagcttcagctttaccgactcagagtatccaaaaggaggcctaagaatctgtatttttaaaagcctctccaaagtgatatgtagcagtaattgaaaaggacaatctctttacttcattgatgaaatagctaagtcccagagaagtcaagaggcttgccaaaatcacaacgaggtagtagcggggtcagaactcaaactcaaggctcccaattctcaacccagtagtattgcccagcatcagttcttatctttgcgttataaatacattcctgcccatcaacagtggattgcaaaagcagggaggaagagagggtggcaagggtcaaaaaatagctatcaggtcctatgttctctacttgggtgacaagataattagaagcccaaacctcagcttcctgcaatatagccatgtaacaaaactgtgcatggacccctggatctaaaatttaaaaatcaataaataatacaaaagaaatacattcatatttttctgaaatattcttcagaatatcaagtgggaatccctttgttttgcaaagctggtctgatatgtttaagtaaatttaaccagatagttgttttctgtatctccctctaagtattaacaaacatttaccatacactataaagcattacaatattgttaggatgattaacaagagtaccaaaatgaaggactcttgctaaaatccttttccagctttttcattctactatttacagacatgtaagcacatccattcatttcagcaaaatgtaacattccacacaaaggttttgaacattgtgctcggctagagaatatttctagtgagtgctcataagagacattaaaataagcatttgtctttcattcaagctttatgaaggattaaaagtaatccaattgttcaatccttcatttaaatctttagtccaaagaacagaagatttgggattgagtcgtaatccagccatttaaatctatgagactctaggcacatcattgccctccttcctgagcctcagatttttcttcagcaaataaggataaaaatctacactcccaatcccatcacttattgcccagggtcactgtgtgaattccactgaacaatgcctgtgaaggtgctcagaaacaacctgcttgtgagggcataagaagcacaggaggaaaaggcctttgggaataattcttttgtctcacccaggacaggttatctgaccatcaggggcacagatggaactctttttggacatggcaagtgggtaaagcacccaaggtgccctgagagatttttttcatgtggtctgaagggccacatactttcgtgggattagtggcatatgtggtatggaaactcataattacattgcaaatttaaaggacagctctgtaggaagaagccaagagcagaataagcatagatgtggtttggattttatttttcctcttgtcaaatttaacttaagttctgaattctataaaaaaagaaaaagagtggtgaaacagtcatattttaagatttttaaaagtcttaaagacatggaaaaagcaaagacgatacctacactgcttatttaaaaaaaaactcgatttgagtttcatgaagtactggcatttgctcactctgtaattctcaaagactattttcaaaatttggtcaaattaaatttcaaaggtcagcaaagtatataatcatgtttgggttcttttttcccccaagtttaaaaaactgacatctatcctttttttaggctatctgaatgtatgaaaaaagagtagaagttattttacagcatatatttttctgtaaaagtaactacatttaacattaaattatttaccagtggtattcattttatataagcaggctggagatggaggttctatttacatatttccactgtcatggtacagtatagtactaagtattttacaggccagcaatcaaaagaattacaattgctactaggaaacactaaatctgaggattctgtcatgactatgtatagctggttagaaaaatctttgctgaattgaatggctttctcattacagatggccttgtttacactgtacttagagttctgtgtgccattttggactcctcattaaaaaagcataagtcattttttaaaagaggataagtgggaaataaaatgggagccaagattatatcgaataaattctacaaaaaaagaaaaaagaaagacaaaatacacataattgaatatcataatctatctagaaaatagatgaagtggcacaaaaatggatgaatatattcaaatgtttgagaaatattacttcataaaaatgagagaaattttaatggctggagaagtaaaacttgattttttatttgagaacatagttaatgtcaaaacaaagaaagtcagcaatgaacattgcttctcaacttgaggtgattagagaagaggtcaaatgcctttagaaaacagctgtgcatttatcttggctgtggacctggcaagtcaacaggatttatgaatagcctcaccatgaatttggtcatcctgaggggaaggaaaaccccaaattaattttggagcagaagatcagtgtaactactaccatccttacgtcttctcaatgagcttcattattcctcccagagtggctagagtaggtagttgatgagcatttgtggaatggataggtatctcttttctatgacctactctatcaccctcaggatctattaatcctttgagtttgatctctaaggtggcaatgaaatatttcttacaccagaaatacactgaaactcagagaaagagggctcaaatttgaggagagtgctatactggcaagaggatgccccaggtaatatcctttccttcttctagagaggaacatttggctctagaaaggcatttagcctatgagttcagaacaggaatggtcttaggcatctgattcaacctacgacattgccagtctgaaccaactcatcctgatcccactgcaaatgagctaggcaacagtgaagagtggttctagtctgggtttggataaattgtgaaatatttctagaatttttctatagactctgaaccatttccccagaagtgtgcacattcaaaatgtcattttgcttcagaataacattttgaataaggcaagcctaatttttgttttttaacagaattttaaaataattaattcacaatatttgtacataggataatgggatattttgttacataaataggatgtataatgaccgagacaaattatttagggtatccagcaccttgggcatttatcatttctatgtagtggaataatttcaatttctttcttctggctattttgaaatatatgatacattattcttaactataatctccctattctgctatcacacattgtaacttatttcttctatccagctgtatgtttgcatacgttagccaacctctcttcattcccctcctcctggtagctatcattctattaccttcatgatatcaactttttttagcacccacttatgagtgagaacatgccatatttgtgtttctatgcctggcttatttcacttaacattcaggtcaattcatgttgctgcaaatggcaggattttgctctttttatgactgcatagtattccattgtatgtgtatgtgtgtgtgtatatatatatatatatgtattttctctatcggtttgtttgttggtggatactttggttgattccatatcttagctattgtagatagtactgcaataaacataggggttcaggtatccctttgatatacagatttcctttcctttcctttagataaacacccagtagggggattgctggattgtataatagttctacttttagttttctgggaaatctctatgctgttttccataatggccatattaatttatattcccaccaactaagaattcccttttctccacttcctcaccagcatctattttttttttttttggtcttttaataatagccattctaaggtaagatacctcactgtggttttgatttatagttccctgatgattagtaatgttgagtactttttacatacctgttggtcattttacatcttcttttgagaaatgtcttcatgtcctttgtccactttttgatgggattatttgggtttggtttggttttgtttttgctgttaacttgagttcttggcatattctggatattagtccgttgtcagatatatattttgcaaatattttctcccatttaacatgttgtcttttcactctgttgattattttctttgctatgtagagatttttggttttaatatagtcccatttgcctgtttttgtttttgttgcaatgctttgacgtcttaagggaagcctatttcgatctggtacttctgaaatctcattggctcaagtgaagcacgggtgtaaatcctgagtgtttgttaatctcggttctgtgtgtcttctgtaatccagagacaaattcatgtgtcaggttcacacttgagctgatcctctgtaactttgctgattgttgttaagacagaacagaaccagactggctttcactttacacaacaatcacaactgtgtgtaatgattatagacttattctctaacatctcttaagcacttaggtaatgagaaatgtcataatgaaaatatctgttaaccgaggaagatcaagggaacaaaacaaaaaacctaaatgaagtgtgaaggtggtagaagtaaagacatagatggtttcacttgggccagagatagattgaatgtgagacatttgaaagtctaatgtactttcagtacgtactttccagtttactttgatggaacgcactgtgttgaatgttattgtgctgacaaataagcccccaaattaaatgacttaaaaaataaactcattcttcatcaagtagcgttctaggatggtgtttaggaggatgtggcagctctccttgctctcagtcacggaccaggattctcccaccttctgtttctaccatccttcacgcatcagcatctttagcatccagctggcagaaaaagaacatcaagataggcatgtgggaggagctatgagccagtcctgaaagtggcatgcaatatttctgctcacatctagtcacttggccaaatctaattgcaagggaacgagaacttcttttatgcccaggaacaggcagagaatggaatatggcagacaacaagcagaatttcctatactcacagtcctgattattgacttctatgctttcccaaggtcattttgtcttcagccagattccatttcaaggaaacatgaaaatgtttcttcactctataaaatcattgttgaagtagatcctgctacctctgtggtagcccatccaacatcttaaaacttttaaaagataatttgtaaccatacataattcacccaatataagaaatcatgagagaaagctaatctcagtgtacttattatacaatgagacacataatgagacatatctttttttattctccactatatattttaaaagaattgaagaggcaagtgattgtttatggccatcgtaagataatattcttatcattgctttgcccagtaagattgaaaaaattgtctgtaattcaggccacacaaccctctgaagcccttcgccattcattcaagccccattaaggcagaaaacccatctgtttggattgttgaggttggaaactgaataatatcacttctccaaaatagatttaatagtagggctggtgaatggtttcctgacctgtttgatgcagagtgcaaacccagaggaaaaacatggtatatgagttttcgtatccattagtctaaaagaatcagaattcggttatattttaaaggcaattatagtagaactattacttttttgttttctgttataatcttacctagacttatttaacatacttaacacataatattttaaggctaagtatttctacaaaggatttatcattcaatcattcttatttagtcaataaaatcttttggagattaatttttagtaagcctaaatacccaaatagccaggaatgtgattgaggatcacatttttaaaacccatccctcaaaaagaaaattgtaatatcttgagagacaggtatggtttgaagatcacccctcttcaaagtgagttcaatatctgacctaatggaatcactccccattccccaggactaggtgacactcactgatctgggaaaaataaacacgtgcaactaacaagagaaattttgagaattatgagtaagctttgaaaatttgggtactgaaaatagagagggagggagagagggaggtgatagggagggagggaaagaataaaaaggaatgaagaaaaaactaataacaatttatctcttaagaaaatagaaggtgcagctgggtacggtggctcacgcctataatcccagcactttgggaggccgaggcaggcggatcgcctgaggtcgggagttcgagaccagcctgaccaacatggagaaaccccaaatacaaaattagccaggcatggtggcgcctgcctgtaatcccagctactcgggggcctgaggcaggagaatcacttgaacgcgggaggcggaggttgcagtgagccgagatcgcaccattgcactccagcctgcacaacaagagcaaaactccatctcagaaaacacataattaattaagtaatgatataaggtgctaaatttttattttcacccatccagtttcttttcttattctttcctgatatgtaattacctcagatgcagatctgaggtgaaactaatgaagatcaagctaagagcttctcactggcctggttccctttcaagttgtaagaagtggtactagcagctgcacgtagttttaggttttgtaaaattcaaaaaactaagatttttttgtattatttttctgaaagcagacccttataattgtataatcttcgtgtaccacaaaaccttgatcccacccctgattgcatggctgactgctgttcaaacagaaggatattcaaaataacccccgttaaaatgccttcttagagatgttccagattatttcttcaaatgtgctaatcaatctcattaacctatttctttaaataagtgaccaactcctagctaaattaaaaaatagttatgaagtttatttaaagtagaactacacagataaccatggtaaatgataaccggtatagaaaaagtaccgctgcgtctaaagatacccatgtattcacgatacaaatatttattgagcaactcgtacgtgtgaggcactgttgtacctgctgggggacacattaacgaacaaagtagatttttaaaaaaaaatctctgcacttgtggagcttatattctaatggggtgagtaagatgataaaataagtaaaaaacaaagttcatcagaagctgttaaatgcgatggagaaaaattaagagtaaggaaggttttttgtttgtttgttcaaaaaaaaaaaaggttaggaggttaggggtgccagttttaaataggccagtatgggaatatctcatgaaggtaacattgagctgatatctctagaaagaatatgccaggcaaagagaactgcaaatccaaaggccctggggagggagtatgcacagtgcttcaaggacagctagggaccaagaggctgagcagagtgaacaagagggagagatgtaggtaaagatgagattagagaggcaccagggaccaggtcactgagggccttaaaccattgggagaacgtagtattttctctgaataaaataggacaccattatgggataatgagtaggaacttgccgagaatgggcttacattttaggaggatcgctctgtctgcaatataaagaataaatgtgggtgggtggctggagaagtagcagggcacatcattaaaatatcaatgtttcaaagtcggcttattaaatcaattttacttgctctatgtcatagaaacaataaataaagacagaaacaccccgcaacactaccttgggtatttttctttgcttgcttgttttttttttttgttgttgttgttaatattttaacttttattttaggtttagggttacatgtgcaggtttgttatataggtaaacttgtgaccccgggggtttggtatacatattattttgtcacccaggtgctaagcatagtacctgacagttagtattttttttctgatcctcttctctcctcccaccctccatcctcaagttggccccagtgtctattgttcctctctttctgtctgtgtgttctcattatttggttaccacttataagtgaaaacatgcagtatttggttttcttttcctgcattagtttgctaaaaataatagcctgtagctccatccatgttcctacaaagaacatgatctcattcctttttatggctgcatagttttccatggtatatatgtaccagatttttctttatccaatctatcattcatggacatttagtttgattccatgtctttgtgattgtgaatagggctgtaattaacacatgcatgcacgtatctttatggtagaatgatttatattccttttggtatataccctgtagtttgattgctgagttgaatggtagttctgtttttagttctttcaggaatcaccacactgctttccacaatggttgaactattaataatttacattctaaccagtagtatataagcgtttccttttctctgcaaccttgccagcatctgttattttttgactttttagtaatagccattctgactggtatgaaatggtatctcactgtggttttgatttgtatttctttaatgattagtgatattgagcattttttcatacacttattggccatatgtatgccttcttttgaaaaatgttcatgtcctttgcccactttttaatggggcggtttggtttttgcttgaatgttcgtttaatttcgttgtagattctgggtattagacttttgtcaggtaatacaatttacaaacattttctcccattctgtaggttatctgtttactctctgttaatagttgtgtttttttttcctgtgcagaagctctttagtttaattaagttccatttgtcaatttttgcttttgttgcaattgcttttggcatttttatcatgaaatctttgccagttcctatgttcaaagtggtatttatttggttatcttccagggtttttatacctttagcttttacatttaggtctttaatccatcttgagccccactttgttaacaagacgctattcctctttggactttagcttgatgaagccacattttgagaaagagtgcattttggaaatatagcatcttagaagtgatcttagaaagtgaaagattggtagtaacctgctgtgagcagtacaaggaaaataaaactgagttattcctgtgggactacagctgactctcaggtccagcctggcctggagagcatgtgcttttctgctcttccctccatactcttagttagtggtcagcacatgataataggatgtaagggaagaaataaatctctacttgttttattctcaatcacagtgacacctgcatgaaattgccagagaaattaaggcctcccaatgactaccaaaaaaaaagacactttccgcttcccattgtcagcacgtattctgattgaatgtatatgtttactacttgaagttctcatgatttctaggtaattactgcaaatatggacctcatactgctactgcaggctttgcctcaagagtccaaataccatggcctcatgttagggccatttgagatcctttttgaaaaagttgctttattgtgctaaaaacaaagacacataatatgagatctaccctcttacattttaagtgtatagtacattattattagctgttagcacaatgttgtacagcatatctctagaatttattcatcttgcatgattaaatgatacacattgaacaacaactctccatttctccctccacccaggcccagcaaccaccatgctacttcctgcttctatgagttcaactactttaaatccctcatataagagggatcatgcaatatttatctttctgtgactgacttatttcacttggcataatgtcctcaaaattcatccatgttgtagcatatgacaggatatccttcttttaaggctaaataatattccattgtatgtatataccacattttttaatccattcgttcattgatggatatttagattgtttccacatcttggtattgtgaatatacataaatgaatatgggaatataaatatctctttgacatgctgatctcaattttttggataaatacccagaagttgaattggtagatcatatggtagttctgtttttaattttttgaggaacttccatactgttttttatagtagtggcatcactttacagtcccaccatcagtacataaggattccaatttctgtatgtccttgccaacaggtttttttttttaataatggccatcctaacaggagtgaagcaatatctcattgtggttttcctttgcatttccttaatgattagtgaggttgagcatcttttcatatccctgtttgccattttttgtcttctttggagaaacgtccatttctttcattgggtttttttaattttgaggggtttcaattgggttttgggggggttttgctattgagttgtaggagctcctatgtattgtagatattaataccatatcagatatatggtttgcaaatgttttctcctaatctgtaggttgtattttcactgtgttttctcccttgctgtgcagaaacattttattttgatgtagtcccacttgcctatttttgctttttttgcttatgctttgatgctgctgtggattaggaaacttaatattgttaaaatgtccacaatgtccaatgtaatctccatcaaaatcccaatggtattttttatagaaatagaaaagcagtcttcataagaaaccacaaaaggctgaatagtcaaaacaatcttgaaaaagaacaaaatatctggagatctcacacttcctgatttcaaaacatattactaagtgacagtaatcaaaacaatgtggtactggcataaagacagacataaaaccaatagaacagaatagagccaagaaataaactcacacatacacagtcaactgatctttgacaaggatgtccagaatatacaatgaagaaaagtcttgaatggtattggaaaatggtattggggaaactagatattcacatgcaaaagaatgaaactaaacctttatcttaaatcatacacaaaaaatccactcaagacttaattataacacctgaagctgtaaacctagaagaaaatttagggggaaaatttcatggcattggtcttggcaataatttgagatgctttcttagagagagtttcagttaagaaaatttttcttaacagtcattaaaaagtaatgtataaacttcaagtaaaacaatttttggttggggctttctggttgccttagtcaactcaggccgcataacaaagtaccctagactggtggcctaaacagaaatgttctcacaattctggatgctgagaagtccaagaccaagattggctgatttggttcctgttgagggctctcttcctacatacagatggctgctttctcactctgtcctcacatggtgaagagagaatgctcttgtgtctctctctgttcttataagaacaccagcactattggattagggcctcatccatatggcctcgtttaacatatgaattctaggggaaacaagatagatttaacctcaacctcaacctcatgtaaccattggtgattaaggcttcaacatatgaattataggggaaacaagattcagtccataacactggcctaataaatacttttcagaaaaattggccttttatcatatcattgtgtcaaaagtgtgctaagcaagtccagcttatcctctttcatttatagtccagacatcaaactcatgctatcatttccatcttgaatctctttattgccctgtgttacttgggagtgtcactgacaagccagaaacatatgttgtatatttccagtaccacctaatgttttactcataagtaagcatatacccttcatctttgtaccagtgtgtgtgtgtgtgtgtgtgtgtgtgtgtgtgtgtatgtgtgtgtgtatgacaggatctcactgtgttacccagactggagcgcagtggcatgatttagactcactgaagcctcagcctcctgggctcaagtgattctcctgcctcagcaccacaggcttgtgccatcatcgtgcctgacttttttttttttttttttttttttttgtagaaacagggtttcatcatgttgcccaggctggtcttgaactcctgagctcaagcaatccactccccttagcctcccaaagttctgggattacaagtgtgagccaccatgcccagccctgggcttttgtttataaaaatcatctgtgaaaacaaagggtaaaacgtgtctgttaaatatcttaactctgtgcaaatatatatattatacaagctaacatgtgtagtataatttagctgtgtaatcttgtaaagtagctaaatatcatgccttctccgggtatcctacttaaatttaatatgcagttttatgattgattgggaaagattgccatctgtgcatatcactgtaaaatgctagtttctacagtctcatctccatagataatcagagaaaagtaaatattaaaatggtgaattttgcaaatcattattttgtttacttcagagaagctatttgacctgcagggaaattttcaatagagaagtatcagtggcattgattagaaacgagcttcataaccttgtgatattgataacaatgggtaaaatatttagtattataaagagggaaaaatgtatgtagtcatccagttacagttactctccccttaagctcaagggtaagcctcccctccccttgagggcaaagcatcaaaatgagttccaatgtgttggctaacagcatgagctacaatacacaggggagagtggagtacaggaatataaacatcagtataattgtgacctgaggtccccaagctacaccctgtgtctggagacctgaggtctgaaggactgtttctgctcattatattcagctggagccccacctaggttgttgggacctccaagccttccacacttcctggtaggaaattattctttctcctcagtgagtaatatctagaaaaaaatcagcagtctccaccctccccagatgttatcacactggaattatggagttgggtggagacataaaagcagctgaaacttttagagcaatctggctccagcatctgtcacctcattgattgcaagggctgattcaggtgatttggccctcagttctcttcctctttcatctctccctttaggttcttcccaaagccatgtgttcaaataaagttaaagagaatgacctagatgaagatctccctgggagaaaaagagtaataaaaatgaaaaacaatagctgctaaataatgggagtgtactagctgccaggcaatgtggtgaatgctttccaaacattttctcttctaatccttataatggccctagagctaggtattgtaattatctttatcagcagtgaaagcctagaaaatacagcaacttgccctagagcacccaaataggaagtggctgaaccaagatttcaaatttaacctgtgttttctaactcttaaataaacatcttaacaggaacatttttggtaggtcaatattttctatgtgccattgttcttactatgtagtgaaaaaggcagctttcagatggtcctggcttcagtgatggctcccaggattcccagcgacattcagcaagatcttccctgtgagtggccttcatagatgcttcggtaatggaggctgctattgatagaggttccttagcagctgctccactgaggccctcattgccccacccactttgggcttcatactgggggtcagtgctaagtataaggtcctgatggctaggatagatgaggaaagctatttactcagcacagtagcaggactctggctcaggagagggcccatatcatggtcaaaaataaattgggaaaagtttaaactagggaagcagtgtctagcaaaaggccaaaaagatgagaaatgaccttcagcagacaaacaattacaaggtcagtagacacaaagtatgcgagcagttgagagcgtggatgaaaggtagattggaactgtattaccatccagtaattccactgaaatggaacagtgtggagaactgggagtaattagttcattcgtcagtttgtccgacttctctttgtttcttgtagggggctggttccatagaaaaggatgggtctgtggagtaaatggtcatgagtagtgctagccacacacattctttaacacttctgaatgcagcaggccagctggtcattactgttactgccccctcatgggagaccaaatatagctatatcattcctcctccaaaactgccttctggcaaaagttatctcttttaagaattgtgtgcattcttaaattgcattaagggaagcaaacatatggaacaagaaagcacctcacttagttccatttgctaagcccttttgcagacccactgacccttccttaattccaaatgaaatctcaaatgctataaagaaacccgccaaatgggttacagcaaagacttttttacaccctactgttatgttcagaattggaaaaagctggggatttggcaaattccaaaatgttgggtcatatgaaaacttttttttttgagacagagtctcgctctgtcgcccaagctggagtgcagtgacgtaatcatggctcacttcagcctcgacctccttagttcaggtgatcctcctgcctccacctctggggtagctgggactacagataagcaccaccacacccaggtaattttaaaattttttgtaaagatggtgtttcaccatgttgcccaggctggccctgaactcctgggctcaagcagttcaccagccttggcttcctaaagtgctgggattataggcatgagccaccacacccagccccatacgaaaatttagtctcagaattagcctttgcatgcgtcacctgtaagttaatcagaatgttactttcaaaagttccctgcaggtgaggaagctaaaaggtattcttgtatttttttaaatgaaacttcataatagaggtgtaaacagagtccattctccccagccttagaatcagacagcttgagtttaaaacccacttatgagcttgagcatactactgaacatagagtcacttgtctatgcctcagagtccccatggtcgaatggaaaatacagtgcctacttcaaagtgttattgtgaggattaaatgagataatatatgcaaagcacagcgcctggaacatggaaagtgctccagaagttttattgttattaacattattattattgccaccatcatcattaaacttggtaatttttactctccccaatcctttagttactttttcaaacttctagttttttgcttgggctccatctaattggctgtgagtcaaaagagaattcaccacatccaagtgttttctaaagaatgtctttggaaaattcacaactgatcattttgataccagcatctaaggttagggctaccttatccttcatcaccttcttgttttattcataacaccacgatgtggactattgataaaattatgtttcaaagataactagcttatttgaagccatctataatttcagcccaaactgactaattaggctaactttcagaaagttaagtaagtgtctaattctcagttaacttactacctactgagtaaaaatgtgctgccttttaaaatccacaactaacctccctactcaaggcaaaccccctagttctaatatttgaagtatttaatgaacaagcctttttgggggtcctcttgtagttaaaacatttatttttctcctttttttttttaactctgttttttgtctttctttttttttttttttttttttttttgagacagagtcatgctctgtcgcctagattggagtgcagtgacacgatcagtcactgtaaccttgaactcctggtctgaagcgatcctcccacgtgtgcctctaaagtgtcgggattacaggcatgagctactgtgctcagcctctactctgttttctaccttttatttgttgcaaaagcaacatgtttattttaacaaatactggtcttcctcatcttactcccctgagatttcaatgttaaaagttgatttgtgtgtttccacgtaagtctttataacaagcttctgctgacactccttggcccagctttccataaacacatccatccctacctattaggttgaactgtacaaaattgccatttttataggtccccactattctttaataccaagcctcaaatttagccagacactaaatgtcctgttttatatacacgccttattcattccttcttggttttgtttttgtggcttcacttttgctggatggcctccacccccaaccccagctctactctggctggacattttttaactctccttcaaaggtgtacatcctgcaacttcttaaattccctttacattcattgtctacatcacatagtctgattgcctatataatacaatttcgtgttttagtatttatatgctatttaatacagatgccacctgttttgctgcttttattttctctggttgcttgatgttctattaccttaactagactttagtgctttctagaaaaggacaatgtgtagtatatctgtacttattcaagtgctgatctaaggacataggatgtaatgtaaaagtttattcaatgactatttcaaaatacaaagtctctctttgtataaagtcattcactaatactgacattggctgatacttcagactggagattctcggtaatattactttttcttgataattaattttgattataagaggatttaatatcatggaaataaattatgcaaatgaactcagaccctaggttcacttcccagaacaaaccgtattctgagaatacttgtggtgccaaaatttagagtgaaaccccagactattaatgatgctcaagttactttactccaacacaataagtactcagtgatttgttacggaaattcaattaagtcttctcaagtattttttttcttttcttttttttttttaattatactttaagttttagggtacatgtgcacattgtgcaggttagatacatatgtatacatgtgccatgctggtgcactgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcatttaagaaaaagtccaataaaatatcagtcactatttttagatcttcattctcaatgtttgtaaagctaatactaatattagattaatgtaattttatcaatattgataattacttagtatacattgtgaactttgttttttggatgtcatttaaagggttattttcatgagttcctaagaaataatttaggcctttaaggttatttaacccttcagtagaaaatagtttccttgtttaagaaaatgatctccatctagtggacaaatttttatattacagtatacaaagaaaaatattaaagcccctagaatatctcatatcaagcacttcctgacctattaataaatgttttggttttagtgctaatattatggcttaaaagttgtaagatttaaaaatatcataactatctaaatgacttaaggtatttagcaatatttgtttcaaaacttatagtggagtgttaagacttgcttgatttaattggaaaaattataattaaagaaaaaattactgatttatacaaatttggtgtttactcagttgaactgaaaaaaactaaaccaaaactcacacttctgtatctcttacatttctgttcatgcacaggaaggagggggtattttcttttttaaagtgtagcaataagaatatcttgatattaaagggaaataaacataaacatttctacaggcattcacattactaggtcctcctcatgctgaaaagctgccatgactatcttcttagaagagaaatctactttgccaaacccccactatttagaagtttttaatgtcttccagttgtgtactaaataccttcaaaaaccttcttaaatactactcttcatgaaaacttctcagatatcccagcctgagttagtcattcatcctttatttttgtatcttaatgcactcatattaagtgcttaataaatgcctatttaagcatatccaaggagagtttgccaaagatccctaatgtatgtctattgaatgattagagaccatcctccccttccagccttcctgggaattgacaaggtttcacatacatatgtgcctatcctattctggtgaaacagatgtcccctgtttgggtgccacatatatttgtggtttatataatcatgcagtagagctggaaggactttaggaacaatcgatgattcaatgcagttagctcagtgactggtcaattaacttttctaggacctggtatcctcgtctgtaaagtgagtctgttcgacttgacaatctctcattgtccttcctgaaccaaataaatatatctataaagagacacaattctaagaaaattttaagttggaaaaacatatttacagctgctcaagataatgagttttccctcttctgtttatttgatggattatttcggagccactgttatttgatcacagattcaaaagtgatccatgaaacatcttccaatcttagagtcataactctatttattaatgactccgataaagaaaataaaggaatgttttaaaatgagctagttaatagtttgaataaagattctaatggggaaaatattaatgacagcaaaacttgaattcacatgtttatttattctttcaacaagtttttctttaaaaccacacacctgctgggctatcataagctatcaccctcctctcctaagaacacatgaaagttgactttattttaatactggttgatgtttcactagaaaggttctttgtggaaagtttatctagattataaggactatgacgttaagaactgtgtgtgtagattttttcccagctctaaaatatgtattgctgagcacagtgccttttattcatttaatcatttactcaagacacttgggcacagttttcaatgtgccaagaatacgctgagtctccatttgtagagagctcacaatctaggaatggagaccgggtgaaaaacattttcaattcattgtaaattctgtcattagggagtgggaaagtgtcttgggagcgtagagaaagggcctttcataaagctctgatgtaccagggtagcctttcaggtgcaggctaagtctcaaggatgagtgacagttaggcaggggaaaggggatttgattatttaggggagcaggaggtgaggtggtgatggcctgtgagaaggagatagtgcctcaatatgagttgagcaagaagtacccaatagctgaggatggcaagttgaggctgggggcaactaattgcaattgagagcagatggttagactggcagtctggcaaagaaattttgacttcatcctgagagcaatggtaagttactgaagggttttaaactgaagaatgacactggaaaatggattcaagacactaatataaaggttgttataataatataggtgaaatttgatggagacctgaatttaaaatattggtagtagggatggaaggaagtgggtacaatagaaattaatgcttggatggatgttatagggtaggagtgtggagggagaagcccaggtttgggagaacagcattaggcacaaaatgggtatttgttgaatcgaattcaaatatttgatgaattactgtgtatttgttattttccgaaaggaattttgtacttagaagattatgttttgcagagtgtttcccttttaactgaagtagagtttggaaaaacctgtatcttgtatctggtcagttaacaacagtatccaggagaacaagaatgtgaagtcaatgtgtttttcttttatgtatttcaatattatcatatttttatggcagaaattagctgtaattttcattcctgctaattccactgtcagttcctcagctgacgctaaatgctttttgaaaatatgaacatgtgaatgttcacagcaacataattccttctccttcctttacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatgtaagtacaagggcaggcaaagagagagaaaaccgagtaaatttatatctagagctgatgacataataaaactaatgacttttgttcaactgtatcactctcctccaatgtagaaagaatatgaataaaattatacaagctagaaatgaatggtagatttaacctgagtgcactgtcactcttgattaacacacacacacacacacacacacacacacacacacgcatgtatttattttcccagaaaatactttataggaaaactgagaattaaatttttaatggaaactaacacttaaatcattagcttatatttatgtagagcctgagttttagctacctaactacatggatattttctaatattttgaaaagctttcaactccattgaaaagtcctgtgataatagactgtatagcattttgaatatatttcaattaatgtatgtacagatgttagcactggtttgccagatcatttaagaaatctttgtgggactttgccaaaattaaaccaacttttaaggatcatgagaggcaagcacagaaaacattagacagacttgaatatcatttaagatatagtacagcttgaaaaacaatgaaaactgacaagcaggtttgcagatcctgtaccatcactagctcattttctcagtgcatttcattcttgtggtagtgtgcatgtttttctacataggtctttattctcactcaatacctatactatcattcgtggcacatctgcctctgtatagaatcgatcttcatctttctctcttggtctatacatttgtccaataacattcaccatcttttcatgacacccatctcaaaaactcataacaggctgcaatttatcttataagaattagtctgtatggaacccctgagtgtctagtgttattcttgccattctaacagagcatcagttgtattgcaataggtctacatggggttctagaaatgaaattatatttcactcatttttacaaactatggttgctattttagcagttgtattattgacgtctacccttcttcatctctaaacaactttctattcctagtggccctatttttacattatttttatctcacttccttagatttgaaattcatgacacttacttattcattcacacataatgagaatgcttcttgagcaaatatggtgtatttaaagctctgaatctgtggagcagtgaggtctggcattttagaccattgtaataaaatatggtgagcacaatccttgaggcatttatcatgtactgcaggaacagagagaggagatggagagttttccacccaagggaaagatacagaaaataccgggctaagggaacaacatttactaaatgtgaggcatggaaaattatggctgaactaaggaatgacaatctgcttgatgtgaatagcgaaacctggcaagagagaagaaaatttcaaatacagtctatgggacctgagagccacagaggtttttagctgagttttggcatgatcatattcttgtttttattgcatcttgattactctattgttgaatgattgcatagcgaagtcactacagggaagtatttcatgtcgaaattcacagaagtaaggcaggctaaatatgatgaagacctaagtcaagggagtgatggcagtggagcaaagagctggtttagatgcaagaggcttatagaatggttgtgtgtgtgtgtgtgtgtgtgtgtgtgtgtgtgtgtgtgtgtgtgaagtatgtatgtatgttgggggacagccagtggagaaggagaatcaaagagagtgctgatttttgtccatgaatgagtacgtacatggtgatgtacgtacatggtgatgaggaacaaagggcagagagtagaaaacatgacagataacaggtgatgaattggtttgtacatgataaggctaggggaaacaagacaacagttaaagtactgggacagcaaacagaaataacagtccagaggaccaggagaaatagaacagttaccttctataattactaggtttttgaatgacagttgagtggtgcgttgtattcaggtaatagcattaggagcccctgggttaaggagtgaattgaaagtggaaatgtgagcaaatgcaggcatctctttaaaaggctgatgggtggagtaggaagaaagaactaaggctgcctgacagagaattaggttcaagcggaatttttttgaattcaggttacttgagctgagggaaggctccaggagatagaaagagactaaaaattcaaggggaaagagggtttaaagatggagctgtagttgctgacaaaaacatgatcatgagccaaagtaaggaggctatccttggaaaagtagtaaataccagaactgtattctttaggaaggacaaagaagacctgccttggcaacatagtgagaccttgtccttactaaaaatccaaaaaaatagctgggcatggtggcacatgcctttagtcccagctactctggagaggtaggaggattggttgagcctgggagttcagggttgcagtgagctacgatcatgccactgcagtccagcctgggtgacagaggaagacaagactgtgtctggaaaaaaagaaaaaaagaagaaggaggagaaggagaagaataagagagaagagaagaaggagaaggagaagaagagtaaaagaagggaaatgtaaatttagagatggaggagtaaaatgttaagagatattagccatgagttctctaaacattttactcctccatctccagatgaatgaatgtaaaagtagaaggtacagccatcaatagccagaggagagagggatggggcagcttgagaagaaagggaaaggcttaaaaaagccactatgcagatcaaaaaagggaacagggtaaaggtgagtagaatactgaccagccccatagataacaataaacaatgttaaataggcgaatgacagaattgaaagtcatctaatgcaacttcatcaaaggtgagtcaggcttggtattgacaaaagaaagaggaaaactcacagtgagttagtggagtccatttatgtagttatgtgttctacctttttaaattgtagtaaactgagtttgggatagattgtttctttcatacattctactccagttagtaaatattaaatatatacatatattttatgaaaagcttatagcatttcatatttaaatatgaaatgcttttatttcaaaatcaaacttgcaaggatacctcattttgctgtgtgcctcaagagttctttatctgatcagactcaggtaggaatgatgagtttaatcagaccatgagtcaacactatattttgctgaaaagtaatgtgttgatatgtttagctttccattctccttggatatttacattggagcagtaagatattcctttgataccaactcctagaaagcattctttctaccaaggagattaagtttctgtggaaggaaaaggaaatagaataaataataactatttcaacatttaatctgacacgacacatatcttccaccataaaggactgtgccttctcttaatttgaattctcatatggccatgtgtaaactttaattttctcaccttacctagttcacaataatgctatgaagactgtctgatgtgtataattcaactgcgctttatagagaatgatgttatatatttaattacttgatgatttcttattaatagttctagttaagctttcctattgagaaattttcttagaaatttcaaatacaaacagtacctaatgaggataggtacctaatgaagggtatttaaaatgaaggtttgtggttatctatttaattgaactgttttggaaaacctttaaatactctttaagtttaaatataactatttactctattgggaaagtgagaagaaggaagataatcccttcctagtagataggatatcgtcatcttatcctctataaatagaaaccaatgaaatagctgaagaacaaaacagataaagatggtagtaataataatcataacatacatggtgtgtgtatatcatcaactttcccaagtattttcacaccagctatcttatttgatatactcacagtccttttgatagggacattgttatgccattttacaggttagaaagccaaagtccaatgagcttaatcttttgaaaaaaaagcaagcattttgattatttctaggagcacataatttgataatgccattgtaaacaaagtactttatactactacagcaaaaactgctgagaaacagaagtaattgttgaccaaattcattaaaccaatgaaatacatagcagtatcaaaatttgattaagaataaaataaaagctcaaggaggtacaaagtaaatatgcagccaactcttagagaatgtatacaagtatatagcactaggctaaattcagaatctaaaaaattagctcatataaggcagaagagaagttcctgaccacttctgctcagagaccgtcacacaatttgttaaatatagatgatgcagtagcaacttaattcttaagaaaagtaagaaaaagaaaaatgttaagtattagcatgagtctagtaaataaatacatgaaaataaacttgcattaccattaatagtaaaaattttttataacagtagaaacaactagataacaaaaggctggttgcccaagtggtgtcatgaagtaacatgaagaaaattacagcgtaaatagacaatatttttgtcatcttaatatttcagcatctgaataacaatcacttctgtgttttcacatcatccagtaatatagtatctgtatttggaaacacataaagttatgatacattgcaaagattaagaggagaattagcaatgacaagataagtagaattaagtcacaaaactatgaatttattaagtataagttacctgtcaaactacttaagttttaagaaatactcaattcacctggataactaatcctctattccccatcctctgttaaattaacaccaacacatagaatgcaaagatgatccaatcggctcttcactcacattcatatacattgcttctacacacagaatatggggtggggtgaatgcattcagagggccagtgacgaggaagtgagtagatttgatataccataaaaagctggggcatatttgggaatctagctaagttatccccaggcactatacagatatctcagacctcactgatcaggccttcggggtgccccattggggcattttctcagctagtagataatactctccctacctcccatgtcaaactactgtcctttctttagcaattaacaagtccctcaccacttcttgggcctctaatgtgtgttttcagtcacagccactcctctctactacttttgcctgctaagtataagagtagtattgcttccagtcctgagtttgaaaaaggaagaagaattccctttatgtcaatttgtatcttttattccagattattaatcttccctggtctcactaggaagaatataaataaaaagacacgttgcattacaaaggttctaattctcactggatctacatgaaaagtttgtagtcatctcttacctagattgcaagataatattacactaatgaacatttcaaaagcatatcaatttgttatcttgaaagctttcttccattaaccacagaaagaaagctaccatggccaaatcatctcttccccagttctgggtttttcccagctggggaggtatcctcacccctcaccctgtggtgtaggagtgatgggactagggccagagttctcaaaatgtgtcctgaggcaacagagggaatgtacatgggtgcaagcgttattttaaatgttcaagaaaaacacgaaaacatctgtcaaccacctggaaaactaatagcttggaatagttcccagtttccaattaagaccatgatattcctttctgtgacaccatatctttgcaaaattgggttttcagcagttgctggataaaaatgaagtgctgagcagaaatcaatgtgcaacaaaaaataagggaggcaatgtccaatctcattccaaaatgagaaattgacatagtgctcagtgggtgctaaattgttagaacaaaaccttattaagttatttggacttaactatttaataattggaactattatttattttggccaatgtgttgctgttattaaaaaattgagatattaagggcaccatgtactgagaaagtctgaaaatatttggattagttgtttattcatatctgaagaattagagctaaatcaggctaggcatggtggctcacatctgtaatcctggcaatttgggaggccaaggcaggcagatggcttgagctgaggagtttgagaccaacttgggcaacatggtgaaaccctgtctctacaaaaaatacaaaaatttgctgggcatggtggtgggcgcctgtagtctcagctacttgggaggctgaagcaggaggatcacttgaacccaggatgttgaggttgtagtgagccacgattgagccactgcactccagcctggatgacagagtgagaccctgcctcaagacaaaaaaaaatgattaaagataaatcagatctctatgtgagactatttgagagaattttgttaggagttaaaaaaataacagtttccaagctgtgaagtatctgatgtgctctagagtagagaatttatctttttcttaattctgttaggatcccaggtagccaaaatctttttttataaaatgtgatattattttggtaatgacctagatagaccaggctttttcttccattgctgtgtgctggccactgttactagtattattcggagtgttgatgcaggcattaatactagctattaaatctcaagaagtttattggcaaaatatgctaaggtcatctgctactagaatacctttttactatctttttgtttaaaaattctgctttatttggtgccatttattcaatcacttaagtcattttatttctgatttaaaaaaatgggagtttcatgaattgtaaaataagtcttataaattagctaaacaagtttcttcaatccttgaactgggggatttaaaatattagctgaataggcattttatattcctaatctcatactttcaaaaaaatcataaaaatgaaatcctgatgtttagacattttaaatggtaatgtttttaatgccacagtataaaaataaagcattgattttaatgcactgctacagtgagatggtgccagcacctctaagtatcattgccagtgctctaacctttaaaataacgaattaattgagttatatgtagtaatatatcttggctattactgccaaagtaatagatatatactgaagtcttaggagagatagagggataaatgttagttataaaaagttgttaaagcagagggaaaaagaagtgaaaactgaccaaacatatacgtaattcattgtttctatgacaagcctgctgcaattcgaactctaggactttgtgctaatatttagcataccattttattttctagatttcctttatactcactatgttcctcagtatttgcactcacttcttttgtttgtttgttttgagatagagtctcactctgttgcgcaggttggagtgcagtggcacaatctcagctcactgcatcctccgcctcccaggttcaagcgattctcctgcctcagcctcctgagtagctgggattacaggtacctgccaccgtgcctggctgattgtgtttttttttttacttttagtagagatggggtttcaccatgttgaccaggctgggctcgaactcctgacctcaagtgatcctcccaccttggcctcccaaagtgctgggattacagactgaactcacttttaaatcttttaaatgtgaaaaaaaaaactctaaaaatcatgtgagtttttctcactcctgtataaaagagaaagagtgtgaaggtgaattatttaaacttataaataatgattatataattatgcttatacatcagatttaatacatttcaaaggataatatctactttctttaaaaaaaaatgcagggagaagtggtagtttaataacaagagcaattattccacaatcctatgagacactgaattcctgccagaagaaagtaaactcagaattggcctcagtcaaggaagattagcctatttttcagtgcataccaaaagaatgcaatctctaagagcacattatgtgtgaaataaactaaaataaggaaagtttgaagaacattttgaaagaaaaaaactagtccagtaacctggatagtgctctcaatgaaacacggcccctagatgaaggacccatagttgaaaattactgattcttcctgcctcttgaaattccaagaggcaaatggccattacaggagagatattggttcacccagttgtggatattgtacctagaggtacactagtgtactctcactttatctcaaccctcttccctctgtatattaaagaagactaaaatcaaaaccatgctccagtgtattgtaaaatagaaatattttgaactttaatttttttttcttttcttttgagacagagtctcactctattattgcccaggctggagtgcagcagtgtaatcacagctcactgcagccttgagctcttgggctcaagtgattctcccacctcagtctccctagtagcccaaacacaggggtatgctaccacacccggctaattttttttaatttttagcagaaatgaggtcttgctatgttgcccaggttggtctcgaattcctgagctcaagcaatactcctgctttggcttcccaaagtgctgaaattacaggcaagagccactatgcacagcctgaactttaagtcttgacggtggggcatatggtggcaggctgggaagaagaagaaagttgacttctattggagatgaccaatacgtgttttccaccacattctaaataaaggtgtgtattaattgatgtgcatttttgaatgagtatcactgttttactcgtttggaaaataacagtagcacctactccatgccagggtatcatttgaagacaccatagatccatgaaagtaagacaaaaaaattgtttggagcatgcattcttgtctttatttaatttttaaaaattcttgatacaaaaggagatgtttccagccaacactgagattcccatatgaatacttgttttcacttacacatcaatcattttaaatatttacttttgcttgtcagtcttagcttcttaatgaattgttctcaatgtctcctttactgttttctgagccatataaggaaaaacagtcacactgctggaacatttatgtgatgtgtttcttgagataagatattccagggagtattactaaatcatactgtctaagcccttgcaatatgaatcatctaaagatgtgcttctataaataaacagaaagaaagcatcaagcagacccatggtttttctttagaaaaccaagtaaggaatatcaaccactgggctttgctttcagattcctggtaatctgtggtatgattcacaccaggttcacagaggaaacaaccccaattattccgtctgcctactgcagcatctcctaggctttgtgtccacctacggttaattgccttgagactttatggtttttcctaaccttgggtcaagaaaaatttgctgacattgaatactggaaagttgtatctaaacatatataatgtgtcaattcctgcaaccctctctttaagacgcagggaacttcagagcagaaagaaaaagaataactgctcacccctcaacaaatgtggaaggttgtgatgtgacaagaaatcatttcaccagttcagtaaatgatgttgtctcccaataaatgtcatgaatgatcccaagtccaaaattttttaactcattgtttcactcccaagggagaacaaagctacatgcagatctcatatttccatgtttcaaaattcattttttctttggtgcttacagaacttcaaattgaatttgttataaccaccaagatcagttttgtttttgtggattggtgtgtgtgtgtgtgtgtgtgtgtgtgtgtgtgtgtgtgtgtgtgtttagctagtggatagcatattagacagcaccgagagtcttgcagaatattctgttgcagaaatagaatgttgcagaaatattctattggacagtgctgttctagagtctaaaacatttacttctatgtgccttcagaatagtctaaatccatttgagcatacagaaagcggcatggtaaaaacaaaacagtatttgaaggcctgggctcaaatccagctacactgaacatttccatgccttgggattttatgacccagtaaaatttctgggacactgacctagggttactaactccttattttgccaggtaaagaacattaacaaggaattacccatcaatatatatgttaattttattttttaaagacattttcacttcagtgaaaaagaaagagcataatctcagaataaaagaattttccaaaggaatacgtatagtttaaaaaaaaaatctcactgcatggtccatgtacactctgactttgacaaggaccactgagcattctgttgggcaagtaccagatcttagagtggcatttggaaaccactgagttctgtcagcttgtcaagggcatgactgccaatgagtaacttaagttgtcagggcctagttccttatgttagaatgggaatatgagcatccatttaatgcagagttgtcaggattaaattcagcatgttggtagaacaccgtgtctggtgcctagtaggcattcataaaacacattgctctcctctctgtttgatcaagggcttccttttaatctattgaatcttttcaccacatgcagacctttaaaattgttgcactagttgaccaaaaatcttttccctaggatcccattctggtgaaaaaccaaaagggcagggccactggcattaagaacaagcctgccaataagataaactgtgaaagaagatcccgttcctagaacacaaagtgagagcacttgtgaatccctgcccatgtactcaactctttcgctgtctttcttccctccatggaagtcagactctcagctttgtactcaaaccttctggtgataatttgggacatcagccgtcctagaaaagtctctctattgtattggtttttattaaacaaaataacctaatatgcttagtgaatatgtctacacacatgtgctaaacatttgtttaattatttaacttggaaaattttggtgtatcatttctaacagagatagtctttgtgccatcatataactaacaaatttgaaggcattcattggcatcatgtattttctctaatgagtcctaaattgttttctcatgacaaataaagagattccattttagactagattattttttgcttatgttgcgtaaacttcagtcccatctgctttatcatcagtgcctgtcctccacaagtgatatgagcacacatgagccaaaaattaaggatttttggttgaaagattttttttttttttttggtcaaagatggggccgggctctaattcttgttttaaatttatttttcatcaacaaataacaaattatatgcatttattatatacaaggtaatattttgatatatgtatacattgtggaatgattaaatcaagcaattaacaggtccatcacctaacaatttatcattttttgtgatgagtacatttaaaatctactctcagcaattttcaggtatactatgcatgattattaattatagtcaccagcctgtacagtagatctcttgaaattgtttctccttctaactgaaactttgtaccctttcaccaacatctcccattccacatcctcccattctcccccaggccctgctccagtccctgggaacaactgttctactctctgcttctataagtttgattttgtttttagattccacatatgtgtgagatcacatggtatttatctttcttgcctggcttatttcactaagcataatgtattctaggaacatccatattgtcataaatggaaggatatcccctttttaagcctgagtaggattctagtgtgtgtgtgtgtgtgtgtatataacattttctttattcatctgttgttagacacttaagttgattccatattttggctattgtgattaatgctgcaccaaacatgggagtgcaggtatctctttgacatactgatttcattttctttggatatatacccagaagtagaattgctggatcatatggtagttttatccttaattttttgaagacccttcatactgttttccatagtgactgtactagtttacattcccaccaacagtgtaaaaaggcttccttttctccatgtcttcaccaacatttgttacctttttttgattaaaaaaaaactattataggtgtcaggtgatatctcatcatggttttaatttgcatttcacttaagattagtgatgttgagcacttttacatatacctgttgacctttttttgtaggtcttgttttgattttaatttttttgtagagaaggtgtctcacgatgttgcccaagctggtttcaaactcctgggcttaagctatcctgctacctcagcctcctaaggtgctgggattacaggtgtaagccactgtgtcaggccattgttttgagaaagacctattcaggttttttgcccattttaaaatcaggttatttgtttttttgccattgagttgtttcttaattcttaaaatattaataagatgtgagcaaacagtttaaatttcagaaaactaaatatctttgaaggtcactgtactagtctgttctcatgctgctgataaagacatatctgagactgggcaatttacaaaaggaagaggtttaactggactcagagttccacgtggctggggaggcctcacaatcatggtggaaggcgaggaggagcaattcacatcttatgtggatggcaacaggcaaagagagagagcttgagcaggggacctcctctttttaaaaaattagatctcataagactcattcactactatgagaacaacgcaggaaagaccagaccccctaattcagtcatctcccaccaggctcctctcaggacatgtggaagttgtcggagttaaaattcaagatgagaaccccatctcaaaaaaaaaaaattctaacctgctttaagaaataaaaatagtggtttgcacttgtaattccaactgcttgggaggctgaagtgagaggatcacttgagtccaggagcttgaggctgcagtcagctgtgaattgtgccactgcactctagcctgggcaacagagtgagaccccacatctctttaaaattttttcaaaatatttaaaatgatcaaaacgggcgaggcgctgtggatcatgcctgtaatcccagcactttgggaggccgaggcaggtggatcacgacgtcaggagatcgagaccatcctggctaacacggtgaaatcctgtctctactaaaaatacaaaaaaattagctgggcatggtggcaggcgcctgtagtcccagctactccagaggctgaggcaggagaatggcgtgaacccgggaggcggagcttgcagtgagccgagattgcagccactgcattccagcctgggcgacagagtgagactccatctcagaaaaaaaaaaaaaaaaaaaaatgatcaaaacaccagaaaagctgcatacacagatatacaaacaggtggcctgagtttggcgttgaaaagtttcaatttggaagatgttacctcacacaatactagacagctttaatgttactcatatattaatttacattttctttgattctcagtaaaaggttgctggacattcttgccaaattgaaagttttggtagttgtgatttttaatacaagtttttgtgttaaatagattattttaattctaagtggcaatagcttcaaagaggaaaagcacattcacttgtaactgaagttggctttattatattaggaactttattccctagggtttcataaatagatgtactgcttaatttattttgacttaaatggagctagtttcaaattaaaaggccaagcaatacagaggatccatatcctcaagtatgtctaataccaaggaaacagtttttatgtatttttggtattgttttatttactatatagattacttagagtttataaaaaaatctaatgcctcctttataagtaattttaaatcattcattatattcttaaatttataatttgtcagagtgaacattatttttggaaaaacaaatcatctcttttaaacgctatatggaaaaaataatttggttttgcaaaattttcttggtagtcacattttacagaatttttgttgtctgaaattagagtttcatgattttaatttaagcaggtagcaatataaaatacttaacattcccatgaattacctgtgcagcccagtttctcatgtagcattttaatatttacctttgtcttatgtatatttaattaaaataagcatgtttcctttaataagtagctttttaaaaatgaatgaatgataaatgaactgaaattcgtctgaaaaacccatatgattattttttaatttatttaaaaatagaatcaatgcttacattttaatacatttggattcacataacttgaaaaattttagagattaccgaatatagattggaatcattaacaatattttaaaagaataaaggcatgtataatttttatggttcattaatgtttaatgctaaaagcaagatatacagttgaatatacactatgactctaattctataaggaagtatgtagtccataatagtcacatactatattgcatacatgtgctcacatacatgcagtgggaaaatgttatcaatagttatctttgaatggttctttaagttgttctatatctcccaaagtatgtatatgtatgcatgtacttcatatgtgtgtatgtatatatatacatacacatatgtatgtatacgtgtatctatacatacacatatgtatgtatacgtgtatctatacatacacatatgtatgtatacgtgtatctgtacatacacgtgtatgtatacgtgtatctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacgtgtatgtatacgtgtagctgtacatacacatatgtatgtatacttgtagctgtacatacacatatgtatgtatacgtgtagctgtacatacacatatgtatgtatacatacacgtgtatctatacatacacgtgtatgtatacatatatacatacacgtgtatacttatatatacatatacgtgtacatacatgtatgtctacatgcatgtatgtgtgtgcatacatgtatgtctacatacatgtatgtgtgcatacgtgtgtgtacatgcatgtgtgtacatacgtgtgtgtgcatgtatgtatatgtgcatgtatgtatgttgcatgcatgtatgcatgtgtatatatgtatgtatgtgcctgtatgtatacatgtatgtatatatgtatatatgtgcctgtgtgtatatatacatgcatatatgtatatatgtacatgtgtatatagatgtatgtatatatgtacatgtatgtatatatacatatacacatacacacacataaagatcaagtaggttacattatatgtttgttttatatgtccatacttctatgaagatgggtctagagagttgtgagtagacgtggtcctcctatagctaatccttgggtgttgtcaaatagtctaggctcccagaaatatttttatattcattttaaaattagaacatacttgtttctctataattctaaaagaagttgtcaagggtgaattgatagatggatgatagtttttaggctgaggaaagaaagatactaagatttcaaaattatcaaaatcttggactttaaaatatatttcaaaaatattattttaattttctatatgtttatcaatttcctaatcctattgacaaacttcagaggagaatatctttctagtaagagtgagtgaagcacagaagatgaaaaaagtttgcacaagattccattcggccagcgcggtggtgcacacctgtaatcctaggcaccccatagactgagacaggaagatcacttcagcccaggagttcaaggccagtctgggcaacatagcaaacctccatgccattgaaaaaaaaaaaaaaaggattagattcaaacgtaagccccagcctgtgactccttcacagtgctagttcatgcattcatttgtcatgctaaaatttgcaatgtgtgatattcaaaagcagtgggtcttacatggccactaatgctttaaatatagtaggattaggggtctttgctccataaagtaaaaactttcttctaattaactgtatctccttttccttatgatttcgtaatagtaaaacagataaagattgccacctagtgtgtttaagatttcaaccaatcatgaaatgaacttctataggaaattatattttcaggtgctgatgttggttgaacttatttttttaagatgacaacaggctttttcatttttaagtacttgaaccatatatggatctcaacaaagtcaccataagagtgtgggcatttggatttcttgcttttagtttcttgcttgtttctgtttccttattacagaaagaaaaagggtagaaaataacgtgataaataatacagaagtagaagaaggatgggagggggaatagagaatagaagttcctgactctactgtcatttctcttgtgagaaaaaaaaagacaatagtatactgttgagccctgtattctcctgctttcaacagcgctggctcaggactcagcaagtctttctctttgggagagacaaggctcgccaggactagtgaagatgactctggttcacttcctggtaaccagggaaggtgacagagcatgtggcacctccttggacatcatgaaatttaaaaccaatgtgacactgactcccacagtgacctacagtggctcatcctggctgttctagaagtttctgcacttgcattctgctgtgactgttaccttggtaccaatctcatctctcacatacatacatatgtgcatacatacatacatgtatacatgtgtgcatacatacatacatatagacacgcagtgtcaaaatgactttttttctgagccttcctatccctcattcattctccgcctgtcctccatgaacactccagttcttttttttaaaagagctgtattttccttaaaacagatcacagctgttttttgttaagggttgttgttgttataattgtttttatttaaatgaaagacagtattgcatcatcctcacccaaaattcacattaccaggcggtacaatttcaaaatgtccaggcgatattcactgtgtgactttgaatctagcttttcagtcactttatagagaccctaatagtctcttcccatctcagaagagactcagaaaaatatttagccaagtaggcctaggaagccccaatttattacattgtattgtaatccctcccagccccactttacgtggcaaggcgctttaaaaagcttctgtgggtaaagttgttcaggtgcaagatttcagaattattttatttcataggatttttttgagcatatgtgattattcagttcattaaaacccacacatactttaaaccaaatcatattcacaaagtgaatcttctgttgatcttaactaccagatctgtttttaaatgattataagcaaagtgtaagacacaattcaaagatatgtttgtattatatttattttcttctaaccacaaataaaaataggttttacttgccttattctcctagtgacagtatgtctgaaaagatctgttttaatattgagttgaggacttagacaaagattttaaaattatatgttaggtatatattcaaagataatttaagcatgacatacttttgaaaataaatggataggctataacctgccgtttatcgaggacatctgccactgaaatgctaggtatcattttactgttactaaaatgagaccatcttgagatatttggcagaaacaatttctgggcaatttattaaaaagtaatatatttccttcactaaaatgataactgtctttatgctttcatagggaaaaaaggctggtaaattatcataaatattgtaaagtgtattacttataatacttataaaggagatacaaccaaagagaaaattaaatgttttaataaatatgcaacccttttgagttttgaaagattcaaatccactgcaatctatataaaaaattaggagacatatttccatggattcatttcagattgatgatgtgccttgtcaagatgacttagtcctgaaaaaaataaactttatagtaggtcaattataaagaataaaatgaaagaagagactatagcttgggacaataagaagatgtcatattattttaattttggttatctgaactgcctctcatccattttacaatacaatgtcttcagcttggccatgcactgaagcagatgaatagtttatcagactggcaaatcaagtcggcataggtggcatgtcttttctccttgtgtaatatacctcccattatggaatttttaataacattttttaatgtcagaaaccattgaactatcttgaatgcaatatatgtagtatatacacctattgaaaatgttttttgtcttcggacttctaacacactacacagtttactgatttgtccaccactcccaagaatgtttggcttcaaatgaactctaaaggtgcctttatgtgtgtagaaatttgtcaaatgctgaagtgtttagctctggattttgtcttcatgctttttaaacactggtgtatctgtaaatatttctcagttgttttgtgagagttaggctactgtttcaaaataagtacataagagaaattgcagccctatatttacctatatgacacagccagaagggaaagtcagaatgatgggccaaggaagaaatgtagctggccaaccctggcatcactttgtaatttgcatttattgggccattttcctagagctttatttttaatctttttaagctgttccataggaatcagccaatgcatatcacaaaaggggaccattccaggtatggctgtgcagcttactacctgcgtgtctttgtgttaaatctcttaatcaatttgagctacaattttctcatctgaaaaatgggagtaatgtcacctaccttgcaacattgttgtaacagctgatgattgtatataaaatacacttgctgtgataacattctttttacttttgtaaatgcttgaaattttcatatctttttttccccagaactttttctttcccccagagcttttaatgctgtcatcgtccctctctctctctctctcaactaccactgatttagtttaggtcctcatctcttcttttctctacactggtctccctgcttccatttttgcccctttaaagccctcaatcttttatagacctgtcacagggtctcaagagtccttcttagcgaagtatcagttttctgagtctttgcaatttcctgactgcataggaaagcaaaaatcattatgatttaaaaggttttactactgctgctaattattattatagaaatgtttattgaacatttactgtgtggtaagcacatttttcagcacttaacattattaatttattgaatcccaaaacatcactctatgtatgtgctgttatctccattttacagatgaagaggccaagggaaagtgaagtttaataacttgcacaatttcacacacctagtatgtggcagagctgaaattccaacccaaacttccatcagagagtaaaatccaagttcttgtacatttcatacaagggctctgtgatctgctgcctggctcgttaccacccatgattctgaatttcctgccttccatggcattctctagaatcaccgagcttctcgttgcagctctgtatctgcttctttctcatctaggcagctgctctgcctccttggcttcatccctctctgctggctcccacgggctcaatggcctccttgccacttcagtgcaccaggcctgctcctaccctgggccattgttctaggaaagagcctttctgggcttgacctcagaagaccttttttttttgagagtcaaggtaaattatgtaaattatttattgatgacagaagaacactatcttagtccagtttctgttgctataacagaatagcatagacagggtaatttatatagaaaagaagtttatatcttacagttctagaggctgggtagttcaaggacatggcatcagcatctgattaggatatttgggatgcatcatcccaaacaatggaaaaatggaagggcaagtgagcacatgcaaaagagaaaacatgaggggctgggctcactttataacaacccactcttatgataactaaccccctcccaccataacagcattaattcattcatgagtgtgaagccctcctgacctaattacttctcacaggcccccacctcttaatactgttgcaatggcaattaaacatcaacatgggaaaatacctttttcaattgacatcctgcctctaccacttattagtttttagaccttatgccctctctgaacctcagttgcctcttctataaaatgatcataaaacccaatgtcctaccttcttagagttctagagttctatgaataatctctacaaagagcaggtgccccttgaaaaacatgattctggaactaagggggtgtaaaataacacatgcttcctttacattgttttttccttcttctgcttttatttcccacatttttattttcaagatctccacatggtttgatgacgaccacagcacctattctagctattggtaacaatttattgagtaacatcatccatatgctccctgtgccccagcatgtttcatgggtgttgttttgggtcactcaggttgttttcagattgttcatgagtgagcgaaaagtttatttgcactgttctcagggccatgtccagggagctgtctgtgttgaataacagcattcacttttgatttaagaattttatctagctagatcaagaaatagctgatggtgactctggaaatccttgtctcaaattattcatgctaagaaataccacaaaagaaccctgggccccagtttctcactttcctctaactggaatgttgcacaactttccttgcccttccctgtccctccaagacacgtcatgctgacaccttgctcccataccccaggcacggtgtagctggggttgctgcagcaacagcacacaaggagtaacatttcccagtgactacagtggctgggatgagtcagttgaacatttcactgggtttttattagtgtatgatgcagtcccatgtcatctacagttcctagcctgtccaagacttacacgggatgatgtggaacactccatgctaatcaccttcaaatattagatggtcaagggttctctcactgaagtcactgcattgctggttccttccacagcaccccttactaatatctacagtaagaggccaaaagtaaaactcaggccccactgctggaacaccatttctactattgcatatcctgtgtgcctaaaaagcaacagtgaccctggctgatgatcaagaagcccctctttttacccagggagttggacaattgttaacatcccagaagacatatttttaacccagttgctgggaagaacatgtgctgaagtataaggatggaatcactgtaattctctatgggaactcatgaaagtggaacttgccgtttaatattgaacgacactgagcacagagttattgatgatttctaatgcgggatttggtttatttttcagacacggagatgacttgattgtgactccatttgctcaggtaagcacagcttggtgaatgggcaggtttctcacagatgtaaaaatttaatttggggaattagttcgggttattaatttaatttaattttaaatcaagcacaagtacaaatacaaattcttggttcattcaagcaattcaaaagcaatgctagagaaagtgactttggctatattaatctgtttcctataaacccatagtaccaaagagtgtctttgcttcaaataataaattagctaagggatatacttaattgggctcatactgacataagcactagaagcagaaggctatatcatggcttaagttatgtttagtataattaggtacatgatcagtgcttgaaattcaatattccaattcaacccaataccttatttatctcttttttacatatgccatttgtgcagagatttagctgagtgatgtgttgatgtttacttcttccttctaggcatacaaatcatgaaaatactttaaccacatgacatatgtgcaagcaggtgataacatgatctaaaatgtttgggaatataaatatgaaagagttgatgaccagatgttctatgtatagaccaatacttctcaaccctacctgcacgttagattaacctagagacctcttatcccagtgcccaggctgcagccctggtcaattaaatccaaaaatttggagatctgttacaagcatctgtatttgttaaaggccttagtatttttctagtgtgcaggagaagttgagagtctctggtatagacaactaagggcggaatgagataaaactgatttaacctggggcatgaagcaggtttaaaaccaacactgatgagtaagaaatgttaaatattaaaatgcaagtaatcctgagaggttgtaaaaattataatcaggcctatatcatacatcaaggtgctcttgcaccttggacaactcacttaaattttctgggtcctcttttttttcaactggtagagttaggggactgagctggatgaaagacagtcagatctagttaaaaccctttcaccgcctcttgccaactcaatggacttgagcgagtcactgaacttttccaagcctggtctcttcctctgttaaataacagttccaagagtacccacctcataagattgctaagacactgaaataataccacgcttataaaatgctaggcacaattgcttgaaaatataatattataaaaactttgtgattggtttaaatgtatagagctgaaaatgttctttcatttctaaaatgtcataagtattattttttaaatggataatagggtttagatagtaggattatgtatagttctactttttaaaactttccaaacttttattactgtaacttagacctataatataatcaattcataagtaacataatgtataatagtaactttttaaattaatgcaggcaattaaaaataaaatacaatcaccatccttttcagatggttaatatcttgtttgctgaaggttttgctggagattatgaattctttctagtacctgtatttctgtgtccaaaaaatttacacttgtatgatttaataatatgatgtgatagcaaaatcttataaagctgagggtttttaattgattactattgaaaacttatggccgggtgcggtggctcgtacctgtaatcccagcactttgggaagctgaggtgggtggatcacctgaggtcaggagttcgagaccagcctggccaacttgatgaaaccctgtctctactaaaaatacaaaaaaattagccaggcatggtgacgggtgcctgtaatcccagctacttgggaggctgaggcaggataattgcttgaacccgggaggtggaggttgcagtgagccaagatcatgccactgcactccagcctgggtgacagagcaagactctgtcaagaaaaaaaaaggaaagaaagaaaacttataattctatatctaagacctcagagagaggtgaacagacaaaatatggcataacaatgtaagtaacatcatcaaacatagaaccaatcattccaatttgagttcattcaagtagctattcttgtttctaaccaaatgatctaggtattattataagaaaaaatatatataaatatttaataacaaatgaaaaaaggtctgtgtatgatatatggtcttttacatcaagtaatatttattaagctgcaacaaatagattagtaaattggacttgaaccctgccatcagtgctcttaaattccaaggaaatctagtcttttacctgattagatattttctgtagtgtacctataatctccaaggaaaaaaaactaatggaatttcaagatattgggaaatacacacatatatgtaatttagtccatgttagtaagctatttaaataaaaaagatgtgtacttaatatacttgaaattagaacttggaatataaatcagctgtataatttataggcatatctgatgcctaaaaataatcccatagtatattaagtctttgcttatgattagctaagtgactcataacaccttgtagagagtggtcattacttgagaggctgccgattttttttaaggggcttcatcatggttttcacaaatggccttttactggagtataagacctggaaagccccactagaattaaaaacaaaacaaaacaaaaaactgttaagccctgaagagtttcaccactcttcatagagcatctgtggggaggggttaagagagaagtcccagtgagtatgtttgagtggccttctcttaaaccctgttggacatgattggcatgttttgctgacccaatcactaacttctcaaattttctttaatacaaagtaaagcacttaccacttaatggtaagtgctattttagcattaactatttaaaactaaaaatataagatacttatgtcacttgaagtgataccaatctaatttgtcctgatataccataattgctttcaccaaaggacagaaaacaatggattttagaaaagtcactcagaaaaatatttagccaagtaggccaaagaattaccctcttttctcagcatgctttgaaaattggaatttcacactaaattccagtgaaaaagctatgcttctcaaaaagacaaaacaaaacaaaaactttttgcataaaagtttagaaaaataataagaaaaagaaaaggaaaattttctaaaattccaaaccccaaaataactgctactgacattttattttatatcccttcagatttatttttctgtgcatattttctgtcccatggctcctaaaaatggccttcccctgtctaaggtgttcaaagatcccctcccaaatccatctcatcttctgcctcttcttgagaactcatttctttatgcctgagtccatctccaaaacacgaatcatggtttccaaatcatggtttcctttgacgtgaaaagagcaaaatcctaaattagaggagaatttaggaagccgtgcaaagatagattgcacttttttggccaggctaaagcctgaaacatcttggatagtaattttcagaaaggatcctatagtatctctccatagtttatcccattgtctaaaacactgtcagggctagaaattcttgctggtgtttaacctaaactcttttccacctctgatttcttatgctttcccctgtaagctcagaatccctttggtcctcagaaaaagtgacagctttaaatatttttcttatttcaattgttaaagtattctcttgtgtttgtgttgaaatcttttggtgtgggtgtttccttagcacgaaggctagagaggaatcccactggagtgcacgcggcaactgacctttttttcttggccagagttcttgggggccaaggagcactaaggaggcacaatgctgataaactgtaggaaactcttctctgctgtcagctgcctccgggctcagtgatcccaggatttgtgacacaactaccctgtagtaaaactctaagttgactagaattttcatgtggaagtgtgtaatgttaaatgaagtagactctgatgaaagaaagagaaaacaggaaaacccaagcattatgctggatccctggagaaaccctcacttcattcagactaaggagatatccctgatttgaaaatacagaggcgggagaataacttgaacccaggaggcagaggttgcagtgagccgagatcgcgccattgcactccatcctgggcaacaagagcaaaactccgtctcaaaaaaaaaaaaacaaaaaaaacaaaaaaaaaaacggggtaggaacaactacatctctttacctttactctaaccaaaatacagcacctgggatacttctaggataaaaatgcagtagttattaatactatagaatattaccatttagttggtaataaaatataaccaatattctcatattcctgcctgtccctcagccacttcacccagcagcaacgatcttgtggcctcatcaccatcctcaagcttgcagactgtgctaggccctccctgccaggctatgaaagaagatagtcacctcgtttcagtcggtgctaaatttttagcttttctttagccttaattaatttaaattacaactactatcttctggacatctaagttctttttaagagcgaaccatataaaattgtctatcaaccttttctggtgtacaaaccagcaatttcatagggtttaaacaaaacataacctggaaagaggttttcttttcataaaaatgacctttctattttgtaaataagcataacttgactccagctttttccggaggtaaaaccgaagtaatgaatctctcccagtgcgggtcgccgcttcctccgccgccagtggcacctcaacctcatggtctgtgttttaccgccatctagtggtaacaagtgtatatggttatgaaaaacaatcctcgaaaccatttattttcctctttttttttaggctatgatgttcagctgtttaagtgttaaatgataaccgtattttcctgctattttcagtgattcttattgtttaataaatgtttagaagcacctaagaagatccgagagtagtgtacgtaaataacattgaatccttccccatgggctaatacatgaaccatctttgtctaaaatttttctgtaaaactaccagtatttccttcctaaggaatatatatttctcatcattcccaatgtaattttgacattgactggctatacttctgcttggtggggcagaagagaaagaaatgaccttaattttctaaccattgagctctgtggaagaaacgtcagggatctttttggttagcaagcattaaggagtaaggacaactgtaaaaggagccttaaagctttgactacagttcttaaagagtcgaattcaggggaagtgagggctgccctgaacaaaagcaaagaacaatggaactttaacttaggggcttcagtaaaactgtttatagttctccccacagcctgcagtaacagatgctccctctttgtgccctgcaatgcaaagtgaaagcttaaaagactaacacagtgataacagtgatgacgacaccaagagtcagtcagcgaggcccaagacaacacccccttataagatttgtctagaaatgttatttacacttctgccaatagcatacatgtcatactgtagaagataatagttaacaccaaacataaaatttataaaatagtttgtcctgctgcaaaagaaaaaaaaacccacacacacacaataaataatctaatactggcatgcctaggaaataatttctctacaagattatttattgcaacagtgtttgtacaaaaacaactttaagatagaaaacctaaaagttgattgctagtggccaggcagctgattgtctgaaggagagaccggaagacagattccttttttcactttttattttgaagtatttcatatatataagggaatatagcttgtaattatgtaaaatataaagaataatactaaaatgaacagtttaagaaatagaacagttatcagtattttaatgtcccctgagtgtccctccccaggttaatctgtttctattgcgtcttttcagaagtaataataattttgatttttatcttaatcattgaaggggagactttttgctttatactcttttgtttaaattctgaagcatgtgaagatataaattatacaaaaatacataaattttaaactaaaaacaaagacaaaataatattaaattagattacttattaaattagaagtttattataatagaggcaaaaactcctctacagaaattttttctttgatgaactaatttttcttttcatgactgatgtttcccttcaaatgatcatagaaaataagttgcctgcatttctatgtctatttacccagctgtcaactgcaatgaacttaactattatgtattggaataaaaatctcagaattctagggttaaaaattttgcctaggaaggggatcaattagctggtgcaatgattttatcttaaagtttccattagtatgtttgatattcacttcttaaaacataaattaagcctgcatgatttaacgacagtggatcatttatccgatttacttctgcatcattcaagatttcatgcctaatgaaagacatcgtggtctgatgtcagcagtcggccatttgaatactccatcataggcagcgtgacctttcagagccgtgggttgtttatatgagataatgagccaggtttttccagtgactgagttaatcacggttggcttcttaggaagcagcattaactcctttaggggaaaattctctaagtcactgtcccaaggcgtacacagctctccattgacttacacaaatgaatgtcaatttcataaacagcaacaacaaaacagagtctgggacatttttgtcttagaaaaaaaattagactgattttagtctaggtctgtgccagatgaaacatttctgaaaacaactctggaaactttgaagcaattaaaactttggagactcttgaattaccaatgctaggcattaagtaaatttcccaagtgcatgccaagtcattaagtcaaaggtaacgctgccatcatgggctaatattggctgaatgctttctatttgccaggcactgttcttggcaccaaacctgtcattccatatactcctcacaacaattctacgaggtaggtatcactatcccagttttccaggttaggaagctgaggtacaaagaggttgcatatctagtccaagttcacacatttactacataacagagccagacagtctgggttgttaggtaatacctactcagacatttggaatctgtgttttacataaacttagcactctagctgtcacccaaatcacctataatcccatctaatatgggtttgaccctggggaaacttgcccatttcaggagaaagagaggagggaagaaggagataaggctctaggaaccttctcctaggctcacttccagtccgttggctactttctagttccaactggaattagaaaaagcgactgttagagatagtgacacctattggtcctgccttgttatgtgtgtgggcatgttgtgtctatgtattcatttagtcaacaaatttttattgagtatcttctgtgtgccaagcattgtgcatgtacagggcgtagcattttacataagaaacgcatccctgagagcttcttacaatgcacaattcagataaccttaacaaaagaaaacaatgtctgcttactagctagagtagccatgtggcaaaggtagaaaaacagtttaaaattcacttcacttgccaacttattattatgagattcttcatcaatttttgaagagatttgggagtagggaattttttatccctaaagtgagctttattagcattttatattatactatttgaaatgtgcaaaaatgcaatcatgttatctgtgtattgcctggaatattgtcttggtgactaaggaacccagaaatactgtggaaactgctgctactgtcaccatgtgcatagacaatgtggagggatttctggaaaatttctgcagtctggcctctctggatttcgtgtggatacctacaaactgcactaagtgttgggagattctttagtggtatatgaaactaagttgcaagcaatatcaagttttctcttaacaaaccattttcaagtgtatttaaaatggccttagctcaagaagtttcaagaatcctttcttgttgtaggtcttggccagtctgcgaactgtacgaaacaactttgctgcattaactaatttgcaagatcgagcacctagcaagtaagatatccttttttcccccctcttttttgctgaacttttaaataagttttctcaacttgattgagcccaaggcaatatgttagacttctctgtgttgttgccatgttgtctgtgtatactaagtcatatgatgtcctgttaattttctataaatacttcgtggtgatggttctaatatcagaaatgaagcagtatgacaaataaatatggtgattccatctgtcagaaatcacctggcatgatcagtcctccgcccagttatttacactcagggtaactttatagtttcggcttacttcataaattaaccgtgggtgaataatctcatcacaccttaagatcagctgaaagtcatcctctcaagacaacgatgatttggagaagcgccatatcatagcaaagatctttgattctcctgctgttactgactttcagatcagcagcattcatggagcaattaatagaattgtggtttatatgacaacagggaaagcatttgaaagatgggaaaggattatcatttcaggttcttgataaaggcaaaaaaatctaaaaagataaaagtaatttttcaatattaaatggaaaactggtttgctgttatttcaatgtccatttttttaaaaaaaatctgctattaatatgaaataaaatattaaaatgccaacttcaaataattttccagaaggaaaaaaaacatttaaatcatattaagaggatagtaaatataagtgtattaggaactataacttacctaagtgcataacatttcatagtagttactacttcttaaaaacaatgagaaatctgaactttacatttcatagtaataaaattgacctcccagattcacgtttttcattatcaaaaatagctctggccgttattcaagtacttcttgtgatagaaaaaagtttttaaaaatcaatataaatgtaacaatgcaagctattggaatggaacccattaggttctgtttttccaggtaatgaatttttgcagtcctattctctcagcctgaatacttctcatcttcttcttcctctcctcatctactgggataattgtcattcattcttttggttgcagcttaaataaaatttctcttggagcattgtccctgatgatacccaacatagacacacacccacaagccctaatcaaagtgatgtgcctttccatctctgtctgattgtaccttgtacttgattcctatgttagcacgtagctctctgtgctcctgttgcctgtttgtctgttgggatgctcctgaacactgtcagttcccagtgagtaggaatgtagtcggttcacatttgtattccctgtgcctagcataatgcagagtctatcagtctgcaaaggcctgttcgctgaaagggcaaagtagtaactcagcatgtaaaatctgagggcatgctttgaggtacctgttcattaccaatcacgttttctatgtaacgtggccgtgcaatgtcatactgacctcagcggcccccttgggctttggggatttggtagcttgtaaggtcaatcacctcccccttagaaagtctcagctctgcagaagaaatgaagttaactggttgtcactcccaaactttttagtctcgaattttacccaggaaactgagatttttgtctttaaaaagtgaacaagaaactccctttatgcttcctttacatgtggtcacctgggtaccagcatttaaatctgtggcaggtaaatagttgatcagtcaggctccagagacgatctgaggcctgtttctatgcaagacagaagttttcagctgacatacagggatggaacagattgaaatggaaaggaggagctagaagaaaacagaaaatcatagcttgagcctgaacttcctctctgccttgtcaatgcccagggtgacatctaaccaaacagtattatctggcagactctaagtaaaggccactgtggtcttccttttggtcaatgcaaatttgtgcctccattactgattcaaaccaaatcggcttctttgggtatcagaatagtaggattcaatctattcacggctaaactcgattctgttcagtgagaacaaagtgctgtaactctgcctcatcacatgatgaccctgggagaatcagaacctttcctgctgggcactcacagagccactagaacatttccaagctcatccttggattttatggaaggcatgtgctcctttgcacaagccaccctttttatttgctgcagaaaaggagtctaggaagaatgcattccaaacccagcccctgggtgggtattcagatgcacattgctgacttgttaacacattactgcttcttgtcaccttgggttttttgtttttgttttgcccttgagattttttattccagaagtgagttctggctcatctgtcattagaggaggtatcgaggcaaccatggatcaaagtattaatattttctgcttgccattacttgttcagatatcaagttcctgagtaccagttaattgtaggattgatagtaaaaggagataattagaattgagtcaaccatttggttttccaaaactgtagaagagtgtgaaaatatttatttaataccattcccagacaaaatcaatggtttctaaattttcacagagcaaggactaaaaaggagtaatcaggatatcaattatttgaatgataaactcttagccagaaggtaacagataacaccctgttacacacagcaagaccccatctctaaaaaaaaaaaaattaattagccaagcatggtggcatgcacctgtagtcccagctacttgagaggctgaggtggtggggggaatcactagagctcaggagttctaggctgtagtgagctatgatcacaccactgcactccagcctgagcaacagagtgagaccctatctcaaaactttaaaaaaaaaaaaatttaagaagaagaagataattactggtatatagaccagagctatttcagagcagctgcttaaaatattaatattttggtttatcgagtttaaattctccccatttttcccccaaccattttattttataactaaaaaaaactaaaataattcagaagtaaaatttggtgcattttcaatcaaacacaaaattttaatcccaaatcgataccaataaccttaggagcaatgaaagggagccagaggctgagtggaaccagtgagaatttacaaaatcccaggctgctttccccaactttcccccaccctgctaagaaattcatcatctcagcaaggcatatttgaagagattgatgccattggcacatatgtgaggctgtgcatgcaggttccacaaaaacatctcaaactaaggcagcaaagcagagcatagaccctaggatcacattcgtttagttcaaatctcagcttcgttacttaaaacaagttcttcaaattctcaaagttttgtttttctcattggtaaaatgagaacaatgaaacttacttccttaaggcttattgtaaggattcaatgagataattcatttaaagtacttatttagcaatgtctgatccacaagaagtgtttattaagtgttcacccttggtagaggcaatatatatataattattatatacctaatatatatatatatatatatatatatatcagacatctttgaatgtatctaaaagtgttttttaatcattatattttaaaagctgtcagttacaagtaataactttataaagttatatttcaaaaatgttgatggatactttataaatgatattcttttcaacataatttattaagcactgacggaatactggatgcattgtgctaggctctgtagggaatataagttaatcagacagcatgctttttttttttacttcaaggggtttatagtcattttgtggaacttggcaaacatctgaaaacttagagaacacaagatataatttatttaagtacctttggcttagagtatttctaaagcttctatagtatctatttggacaagtcattaatatacctctctaacaaatatatcagaggtgtttttcaatataagaaaagaaaggaaaaagttcaaatagcttctctaattataagatagtttacaacaaatcattcacttctgataatgtacaggcaatcacgagaatttaggccaacaataaaaatttcttaaccctgtattagggaagacaattataaattgactgctttttcaaattcagagtctataagctctggcttcagcgaataaagtctgtaagaatttcctcttctctcatgtcccagtgacacttacatcagctttatttaccccaaatcaatcactgtgagatttaccagttttctttttggacatgtgtgatctgagccataatacaaagaacgcctagggacttgtctggctagtctgaaagaaatcatttgcgtgtccaaacttaaaaataattctttaaagtaaaatgctatatctgaaatgactcagagagtgatcaaatcaataagccccacatatttactgctttgtgtttttctgtctttgtcagaagatcacccatgtgcaaccaaccatccatcaacaaagccaccataacaggtaagaaagatctggagcttattcttcatgtgtctaggaagaaaccatttctgccaagagtcaatataacaccaacaccaatttcatgctgcaatttgaaaatgttaaagaaattctttcttctctacattatcatttctatcattgatctcacaaattgtctaagctgttatttggaacatttttaccgatttacgttttttactgatgtacattatttttaaccatttaactatgtgcttatactcatttgagcattgctctgggcatttgtattttgagagatgatgttactttcaagtcacttcccattctggttccacacatgtgttattagcatgatataatatgtcatcatttagtttaataagagtgaaggcataaataaaaggagtaacgtgttggttcatcaatatcccacttgtgtgtaggaagcaacattgtaccagtagtccaataaaggactgagagagctgagaataaactcagtttgggaggggagagaagttaatatacaatgcagaaaaagttcaatgagatcaaaacgttgggatctatagatgtttgggaaagaaaaataggaggaaagatgagaggagccaagtgcataaaaataaaattatctcaattcctattagtctgttttaggcacaggacttgaccccagctgaaccaaaaacagaatgcatgatctcattttgctgaacctgaaaccaaattgaactcttttgactatttcttgaaaccccaattgattcattaaaataattgcctggaaaagaaaacctatgttttctaaaattattaccagaagaaaattagcatattctccaaactaaaacaattcgtcattggattcaagtgtcttccttgagctccaacccataatgtgctgaggagctcttattaagttattagtgagtacactttgcttgaaatttaactttatcatgtccagacgtctgtctgtgtttgtggtcaccacattagagttgattctggaatcattgttaatgtcatcttttctgaatgtcatcaagtgaaacttgtatttcaatgaatgttaaattattgatctcttcttcatgtttctctttcaacatattattggtgatgacttccaattatcattttatagtacatatatggttaaccagttttgttcttgatattgatcaagagatgaacaatagggccaggagtggtggctcacgcttgtaatctcagcactttgggaggccaaggtgggtggatcacttgaggccaggagttcaagaccagcctggccaacatggcgaaaccccatctctactaaaaatacaaaacttagcatggtggcgagcacctgtaatccaagctactcgggaatctgaggcaggagaatcgcttgaacccaggaggcagaggttgcagtgagccgagatcgcgccactgcactccagcctgggcaacagagtaagactgtctccaaaaaataaagagaaagagagatgaacaataacaattcctatatgctaaaataaatactttgagtaactgatttcttctgccaaaattcaaattcaacataaatgagtctaaactgagttggaggtgtggaaccggatccctctgtttctatgcactttcctaagttgaggaatggacaggcctacatttatgaacctgtacctgaggcctctagtgagagaagccacatggaagctggtcttcacgctgctccaggcactaaatctgacccctatcaagaggaactaccctcaacccccaattttgcaataagcaagaactgacattgctatttgggcagaatgcagtgctattttggtccctggaagcttttttagcttgaggtcacatatgagctggcctcacaggtggagcagcattctcccagaagagcagcatcaggtaccagtggaaattgttgtggctgacaacagatggttgggtgctcagtggtcagggcagctgcccagccatcccagcagatgccaggcacagattaacaggagagagtagctacactcaaagggcacacacttgatcttaagcatatgtgacagacctcatagaagctcctagaaatgtatacatagtaagggggtcctggagcaataccagagggaattatgagccacagaaattaagaaattaaggtgaatatggcctcattcgtacccacaagctcctgacctgaggcctagggacaagggggacacagaaataccttatctagaaagggaaactaattaactgttgttaccacttagtgctgctgggctcctcacaaagcacaacaggaaatgaactgactaaaactgggaagtcgtttttcttgcccaagcatagcaaaccaaggtgggaacatggcatagggatggagggatgagggcagtagcaggggaaggttcccctttctgagcccattttgaaaaagtgggcccttaaaacctcagtgctagtaataataatgatggttgagattttgacattagtaagatttgagacactcagaaaaggcagtgcttgtgcctttcctccctctgcagctgaccactcaggccccaccctctaggctcactccccctgaagttggaacctggctgtactgtggcagtagtcctgggaagggcaaagaagtattaaaaagagtcagtgaggcacccttaagatgaatgggtccctgttgataggggtcagacctagtgcctggagcagcatgaggaccagcttccatgtggcttctctcactagaggccccaggtacaggttcgcaaatgtatgcctgtctatccctcaacataggaataaggtctagagtaacagtgtagcctaacagttaagttcatggctgatccaaaaggctgctagagcacacagctccaagtgcctccggagggcaactccacagaacatcacaacatggtgcccctagaattataccacgtggttgctctgcctacccagcactcaaatcatgctctatcatgagagctttgtggccctgggcaggttgcataccctttctctgctcagtttccctacctataaaatagtgacactgcttcctgcagttgttgctggcttgaatgagtgaacacgcatgatgcccttagcatagtgcctcacagaaccagcacttaatacatctttttaaattccattttgttgttattacttggttttgtttctagggcccactgtatacatagaactaggggtttcttcatcaattcaggctgccataacaaagtaccatagactgggtggcttatagacaacacaaatttatttctcacaattctggaggctggaagtctgagatcaggatgccagcatggttggggtctggtgagagtcttcttctaggttgcatcagtgccctttgtaaaggcactagtctcatttgtgagtgttgagtgctccaccctcacgacctaatcacctcccacaggcccggcctccaaataccaacacatattgggttaggatattgaaatgaattttaggggcacacaagcactcattccgtaacaagggggtaatggaaagaataggacaaagacacaaacgaaggaaagggaacagtgagagaaaggcaagcttgcaagatcatgagaggaaaacttgtgggtccttaaattggccaaaatggatgcgcttgctttgtgcccatcaaaatggggtctcctcctgctcccagcactgtctcctttattctcatcacaattcacagacgctggtagctttgtgatagagatgatacactgttgttcaggatgaatttctaagtctaagaactcacttttgagtcatagttgtttgaaggagaaatattaattctctatcacttttctgtaaaccaactctaatttttaaaaaagaagagttaagaacttcagcagtctacatatcacataccatgctttctaaggagttgtcacatagaatttacaataccctcttcctcttttcaaggttattgcatttgacatgtattaaagccaggagaatttgatttttttttttttttcttgagatagagttttgctcttatcgcccaggctggagtgcagtggcgcgatctgaggctcactgcaacctccgcctcctgggttcaagcaattctcctgcctcagcctcccaagtagctgggattacagatgcccaccaccacgcccggctaactttttgtgtttttagtagagacagggtttcactgtgttagccaggatggtcttgaactcctgacctcaggtgatccacccaccttggcctcccaaaatgctgggattacaggcatgagccaccacacctggccgagagtttgattttatagcattagggttttaaagctaggttttaaaggtaggtcactggccagtttttatttcaatatatagtaggtaaacatacaggtctaaaatgatctaacaattccttaaaagtaaggctttgaagtttgcatttataaaagagacttaaatagctcttttgctctttagtgtgatatgacaaagatgatgtgtggcatttggagcctgaatgtgaacccagtctctcctttttgcttcatttcctcattttggagatttgagtacctaacacttaggactgttgcaagaattcaaggagataagttatataaaaggatagagttcaagttgggcatggtggcacacccctataatcccggctactcaggagaccaaggtgggaggactgcttgagctcaggaattcaagaccagcctgggcaatgtaatgagaccctgtctcctaaagtaaaaaaaaaaaaaaaaaaaaaaaaatggaggccgggcatggtggctcatgcctgtaatcccagcactttgggaggccaaggcgggtggatcaccaggtcaggagttcaagaccagcctggccaagatggtgaaaccccgtctctattaaaatacaaaaattagccaggcgtggtggcaggtgcctgtaatcccagctactcgggaggctgagacaggaaatcgcttgaactctgagggcggaggttgcagtgagccgagatcaggccactgctcttcggcctgggtgacagagtgagacaccgtctcaaaaaaaaaaaaaaaaaaaaaaaaaaaagaaagaaaaatggatagagttccgaatgtgatgaggaactcaccaagtgtttcttcctataaccctgtcccaatgcctgacatttttttgttcctaaagctaatttaaaaactggtagaatagaggtaacagagaatattggtatgtcagcttctttggtacatttcatttatgattttgttttcacacagtcatggcatgacatttttagtaatccttttatcatttagagtaaggctcacctacatacgtccttaatgtgtggtgcacaccagaagtaaagagtgcattggaacatgagagggtggcaaagagtcagagatgcccaagccatacctgcactgggacagtgatcccatttttgaagtacagccatgtagcttggagcacagtccttccttgtaagcatttcattttcgaacaaccttagctcaaggcaagcattctgcagccatctcattaaatgttacatcttcacaataccattttcaatgcttctgaatttccatatttccaatatgtttatttaatcatcctcaattagaggattttcatgcaaggacacaactctaaagaaaacgtatttaaatatctttattttaaagatgaaaaaactgagacctagtgagagagggtgctgcttagtgacaatgccaggaataaacatgtggttcctttttcgagtccatggtccttcttacacctttataaagtaaaataaaccattagattcgggtggcctttatacccaccgtggaagtatatgctttagagaaagtaaatgaagtattaatactaactcctgagtaatagatgtggcattgtattatttgtatatgagcttgaaaatttctcatcccaacctctcactggacatatctctgtagttatagctattttgattatatctactgcttataccccagaggcatagagaccagcaccctaaagcaaaagacttctggattttgactttggaaaatacaaattcttctacaggagcggtgaaactagtacagctgcctgctctttacctgtagggggagacacatgatgcagtgacaagcatagaacagcacagaagtggttttagtccagaaaataaataaataagtaaattggtctaagtcttcattcctttttgtatttttttaccctgaagattcatggcttcattaaaaacagtaagtgcattctaaatagaatttagtcaattggcacgtagaaaattaaaaagtaaactatccaaataatgctagtctgtcaaaacacaatgagaagaaatttaatcttatatgtttgttgttctaaagcacaagcagtttctaagaattaataagggggaaaaacaataatgatatttaattgggacaattatttttttgttatctgggctaatcacttaatgctttgagcttatcgaatgaaagaaactaagcaactatttcatggtgacaataaggatgctggctacttacttagatctgccttttaaatctgtgtgtgtgtgataaaagcaagtagtatatatagttttttaaaaagaaatatagagagatctaatagatgggagcaagaaccatataaagaaggcaaaagggatctacatgagagaaatatgtaagtcctcaggagatactgaagtaaaacatgtgttgtgtcagtgtatagggaagacaagagacccagccattgccagagaagccctacttcctcatcaaccaccagcaggcagcagcttcatgctgtagttctttttttcctttaatagaataaagattgtggccacactttaataattgccagaaatatgtgttcattaagctttttaagaaatgtgatcgaaaaatgctgatgatacattgtgtttaatagctttaataaaaaactgataaagcatctaatacatctaatgactgtcggatttcctaaatcttttaagctgaaggagtttacttttacaaaaatcctcattgaaaaagaatcttccggtaaaaacattgaactgaaagatttgcataaatgcatggagtattactatttattagttaaacttatgatcttttagagcagtaaaagtcagttctctttcttacaaatgaatttgttttggccttttatgcttttatttaatgagtagagccatacctattaatatataaaaagatcagatctgacaccgtggctttttgaccaggaattgattgaagttagacttgttttaagaatagtgaaaacaagggctatgtcctaattatgaggggaaataatttaattgtgtctctcttgtctgaatatctgatttggatgctttgttataactttaattgaaataattaaatggggctcatgttcatttagcctagcaaaaaggtgatgagctagcatatatgttaaaaacccagctttcctcttagtagttgtctaattttggtcaatgtacttaaattctccaagttttgggggtattctttatcagtaaattctaattcagtgcttaacatagtacttggtactcagaatgtattcaacaaatgttacttatcattattgctataatattattattattattatctgcttggtcaacagtattttccatgcaccttatatatggcatgcatacgctctggaggtaaaatgtgactactggttcaagaaatttacaaagtaagggagaaggaattataaatagttaagtactagctaaatgccatgattgaagcctttatattttttattttaattaattaattaatttttagaaatagggcctcactctgttgcccaggctggagtgaagtggtacgatcttgtctcattgcaacctccgcctcccagtctccagcaatcctcccacctcagcctcctgagtagctgggactacaggcatgcaccaccacgtgtgcataattttttattttattttttgtattttttgtagaggcggcgttttgccgtgttgcccaggctgatctggaactcctaggctcaagcaatctgcccaccttggcctcccaaagtgctgggattataggcatgagccacagagcctggactgaaacctctttaaatatatatatttatataaatatatattatatataatatatacaaaatatataatatataatatattatatattatatattttataaaattatatatatttcttatataaatatatatttcttataaattgtataaatatatatttattatatattatatacatatttattatatatttattatatattatatacatatttattatatatgtattatatattatatacatatattatataaatatatataatattatatatttattatatatataatatatatttattatatatataatatatatttattatatatataatatatatttattatatatataatatatatatattatatatataatatatatttattatatatataatatatatttattatatatataatatatatttattatataaatatataatatataaatataattctcatataaataaatataatatttattatataatgtatttctcatatatatgcttattatataataaatatatttctcatataaatatatatgtttattataaaataaatatataaaatatatattaaataattatattatatatttaatatataatatatatgaatatgtattcatatatagagagagagagagccagtggctctacctaggaaatgctccctgataaatttgaagaacataatgctttccatgtggttaggggaggattgaggattacctcacaacaaaagaccagcaagaataaggtatggaagcatggaatgcctgtccatatcaggggactgggaacagtaaaggacaaattgagttaaaggtgtataggagcaactgaacaggatgctccagaggtagattaaggaaataatatttgaggcctacataaataacagtggactttattttatggacagtggaaaatcattgagcatttccaatcgtaggaacaaatacacatttcagaatgacagtaattggaagcagtgtagaaagagattgaaaagaagaaagactaggggcagccccatactcttcagggggctgtcacaggccttgtacaggatcaagataatgcagctctgaactggggtggaagtggggctgtggagatgagggaatgggttcacaactcttcagagataggattgaagggacttgggggttgattagagcagagactgaggatgaacaattttaaagtgaaagtatgagccaggtgtggtggctcacgcctgtaatcccagcagtttgggaggctgaggcgggtggatcacctgaggtcaggagttcaagaccagcctggccaacatggtgaaaccccatctctactaaaaatacaaaaattagccaggcgtggtggcacgtgcttgtaatcccagctactctggaggctgaggcaggagaattgcttgaacccaggaggcagaggttacagtgagccgagatggcaccattgcactctagcctgggcaacaagagagaaacttcatctcaaaaaaaaaaaaaaaaagtgaaagtatatatacacatgttcattacagcactgtgaatgtgcataaagggttaaaaacaatccaaattctaaataatgtgtgaattctatttaggtaggggttaaaaaattcccataataaaatgattttaaataatttatttttgagaaaattttaataatatggaaaaatgtttgtattttaaggaatacataataaagtgccatgtgggcaataggcacacatttaatgcactttaattatgtatattgaattgaacttaagttacttttagttgttgaccagtagttagcaaaggtagataggtttaccattttacattgaatctagtgacaaacatgttatttctcaggtcccagttgttagtttgcctctccttgcctagaaagggcactggtgagacccgccctaacaatatttcaatattatggttccacagtccagcattaactgtattttaaaataataatatctctcacatagggcagcattttatggattattgagcctatgacaaaaatgttgtattatccttcagatgatcagaaaaactacccttagggctgggtgcagtggctcacacctgtaattccagcactttgggaggcaagggaggaagatggcttgaggccaggagtttgaggcaagcctgaaacacagtgagacctccatctctacaaaaaattttaaaaattagctagacatggtggtgcacacctgtaatcccagctattcaggaggatcatttatgcccaggaagttgatgctgcagtgaaccatgatcatgccactgcactctagcctgggctacagagcaaaactctgtctcagagtaagaaaagctaccacatgaataaaagatctcagtgtcaccaaagtccactcctgccagcatcccttccccgctgccctgagtttaaaaagagcaatacttcccaaacctgtctctgatcaaaggaatccccaagggcttcctgagaacaaccacaaaatgactgattcccagactttccagaactgaatgtctaggataaggctcaggatctaaattattaacaaatactcccaggtgaatgggcttgattggccaaatttgggagaataatggaatactgaagaaagcaggtgagagggctgcctgtgtacagtgttgtcattgagttgatgatagcttgttggaaaatacctgtctttctggaaagtatatatagtgacacccacaccctcatctaacaaacagtgcagcccaggataagcacgatcatatgtgcaaagtgctccacgattagtgaaagaagatacaaggtgatattattatctgtgctgacttcgtcatcctgggcatcagcgtcagggtcatcatctgttatctctcaaaatacatacaagattttaagtagagcagcttgctcgtctctgagaagaaaatcaagtatcacatctacctttgtggatgtgggagggagggaatttgggaaatgtttagtaattgcattctttttgtcttcttggacacagtaccaagtctccttaaactaataaaagaaaaaaaaaaaataaaagaaccacacaaactgcattcttcagtcactccctttctccacaaagtgcttcccacccatttcagccttaaaaaatattctaggcatactcagaaatacagtgactgtggtggggcaaaatgttgaaaattcctttgaggctcatttcccaaattttactagttggatgttacactgaattatttaactctaaataaatagggagtgcactcacagcgtcgtttcttttgttatatcaaaaagcctctctcaaaaaatgctttaaaaatcagttggatatattattaatactaatattaataaaagttaacatttactgacatttgaaatgtaccaaacactctagatgagtaatctttttaaaccttatgatatccaaagaggtagacaccgttgctattcctgcttcatagatgcaaaactgggctagacaagttgaataatttgattaagatacataggtagaaaattacaaagtacggattgactcagagggagaatgtcaagtcctctcctaaaatgtactggcatgtacacacatacacaagctgctggatgtgctggtcctcaaaagttattccctagggacatctctcttcttttttttctctctccttccctccctctctctctctctttctttttcttttttcttttgagaacagaaaacaaatctataccatctattcctgaatgtatatgagtggagggtaggacaagaggagggataagatctgtggatgcacagaaactctttgggaaaccctaaaaactctctatagttatataagctaaggaaaggattcctgccagggggtataggattcttcaattcccacacttctcttcctgactcttctgaagtgcccgttgtcaccagagtgcccaggggcagagcattgacaaggaaaggcccaggtgtgtgtgagaagtcaggcagatggggtgtttcggaggaaccagggtaacgcagtgcttcagcgttagcactcaccttgcttctgggaccacttaccacgaaggcctgaaagggcaggccccaactactgggaatattaatcttctctttgggtgaagtctcttcatgccattatcatctcttagctaccattgctaggcaaaagtttcctagctcaccatgtcctgaatgcacttccttgagatatttctgatgcttaaatatccagtgctttctagtgtgccgtcttccttctgtatttttgttttgttttgttttgtttttttgtggttccttttcagcactgttggtcctgtggaagtatttctaattgactgtattctatatgccacacaaaacagatgggtgtttatgacattcttttctggatatgtttctgatgtttgcatattgaacacagaactgtccacatagagaacttgatttctgcctcttcctggctttgcttttactcatttagtccctagtatgtgaaaggctatgcttaggctccaaggacccaaggatgaataaaatacctccagtaagcttcaggaccattactctagaggtttgtggaacttaaaaagctaaaatgtgttctgttgaatgacaaaaagcattaagttaatagaaaacagagggcttataagtgaatggataaatgaataagtaaaataaagaagagagaaaggaagggagagaggaagaatggagcagatgcaggtgagattgtttttctaaagagctaagaagctgcctacagtgttagcttagagactgaaaatggtttgggaaaataattcagaaatttagggaatacttcacagcatgagaaagtggagggctgagattggtaaaagaagacatgtttcaaaatagccaaaaggaaaatagaaaagaactggtcgtgaaaccgagacctcagagttgaatgacaagtaagatacctctgaagtcactgacagtggactgactgttatttgactaatattgcttctacagagacagacctaggttttatcctcccatagaaaaaaatctcaaacattggtaggttttgtttttgtgttttgacatacaagtcaaaatctatgtgaaggaggaggaacaagactcaggggtcagaaaattggggtttcgtggctggctgtcctgctcacccactttacgtgtgaccttagaaaagtcacgccgatgtgttagatcttttctgttaaaatgtggtgggtaataattataccttcctaattttgaggaattacatgagataatctgtgtaaaaaaattagcacggtgtctgggacatagtaaatgtcaggtcttatttaaaagcatgtggaaagtgcttaatatgttgaaaagtattataaactaccaataaatattattatattattcaattactgttgatcctcaaaacagccatctctggaaactgtgcaattatttgagccctgatgccattgctgaaagcattttggaagtggctttagagaccatttacagaccatataagacacacacataccaaaaagcaataagcaatctcactggtttatagtaacacttcacttatgaccaaaaatattatttccaatatgattaccaaccctattcaccagacagaatgtcaaattagcttagatggggctaactccagaaatgaaaccattctcaagggattttaaagagttttttaagaagtatcacatggacttttaaggcaattccaagacagggagccctaaaatcattacaatgatggcaatgtgtggaataagcatataaacacattttcccagatgcaactttgaaggagacaaaatctgaattctaggcagtttgtgaaggaaaaggagcaatttctgggaaatttcttttacccctcagccaacctcaagacagtctgtctttctacagaccctcccttgctgtttctctttactggaaactgttgagggtactggaaataaaggagaaggccaatgtatctaagaccagtggatcagagaggagcccaagaaccttcatcatttccacagaaagggcagcagaggaaattaacctggccttttgtcatgctattatttctcagtgagtctattaaattattgtggcacactaaacagtgttgtctgcatcttgttctttggggattccatacaattctccccttggctggcttatcacctccccttagaaaatggtgtctcagcaatgatcctttgcttgcaatacaaaaaaaccaactctgctcattaatgcaaaattcttagtggaagaatataggaagaattctgaattccctgagaattagtggggcgacaggtggtggtgggggtgctggaggacgaggtttgaaggaatcagtgcatctttacagtgctagaaggctacaaatcaaggggaaagtctcatggcaggagtagtcgagtgagatccccacaactgttcttagtttctttgtcattatttcaagagtcaaacagcagtgaagggatctaatttgtcttgtttgcgtcctgggccttggctaaaagagaacaggcaggtggcttcagttctaccaaactatgttataaaatgtggtagtaagagctgaatgatgggaccagattttgtgggttcatattctagcactacgacttacagatgcttgtgctcaaacaattcatttaaccttccagagcctgaaattcctcacttttgaagtaagcacaataataatatttatctcatagggagttcatgaaaattatttgaggagatatttatgaaaggctgggcatggttgctcacgcctgtaattccagcattttgggaggctgaggcgggcagatcacctgaggtcaggagtttgagaccagcctggccaacatggtgaaaccctgtctctactaaaaacacaaaaaaattagccagacatggtgttgcacacctgtaatcccagctccttgggaggctgaggtaggagaatcacttgaacctgggaggcagaggttgcagtaagctgagatcgtgccactgcactccagcctggataacagaggaagactctgtcttaggaaaaaaaaagatatttatgaaaaatgaagcaaaatgcatggctcacagtaagcacttgatcattgctggttaactattattaagattatctaatagggatacaaagtatattcctgaaagaaattagggtgctcttagataggggaaataaatgctagtaggattggtttcaatgcactatttattttattaatttatttctcactgaatttctttttatgatactcattttttttagagatccagatggtacctgtcattaatgtatcctgagaactcagttcctctgaaggcacaaaaataatttgaccatctcatcatttgatccacacacatttattgatgcctcttttatgcttggttctatacaagacgccgtgacgtgtggcccctgtaggaagtcctggcctctgtctctaaatctgtcatctcagcccaacccctattcagattatctgtgccctctgcgtagccattcacttcgcctgggtgcaatcatgccttccttacccaacgtttaacaagtccagcctagcaacctacatcatgccatccaacagaaggaaggcattattgactcagaacaaagtataggcgctcttagaataagtttattaaatcatttttttaaaaaaaagatatgtgctttttcccaggggagcagtgaggcattgtcagagggtggattcattaaatcaatacagagaatcctggctgcactatttgttagctatttgactttgggaaagttattctctgagccttgatttctcattagaagacgggaataatagcaaacctatctcagagcattaagtaagaattaaatgaagtgaattaagcacgaaacctagcatctgacgcatagtaggaactaaaaaagaaatactagttcttgaataaacatttttttcttgactgtactgtgatacttccatcagtgagtttccaaggcaaatgaatcatctttagaattggaagctcaatgtaagcaacaatgaagtaaagaaaacaactgaatttctcttgaaattattttcctttactgacttgtctttattgtctgtgttcacaagaaactagctctgactgcaaaaatgtctgcctgtttctatggccagttcttttctacatgtttaaattcctaattgtgcacacaatcttagtcacaatattttcatgtgcaagcaattaagactcatttaacagccctccctctggaaggttttgttctccatctgccacaaatcagattccttaggaagatatttgattttgaaacaatgttaaagtactgttcattttgttcaaatttcatttatgtaccattttttaaagtgatgtaaatggacagccacaaaaagctcagcagctggtcaaaacaaaacatcaaagtcaccattgaaatggggcaaaaaaattaaaaactaatatgctgggacaatgccaaataaaaacgatagtctgataaacattcctcagacacattttgctcataacaactatttcctttacagcagatttaaaatatgggaaaataggaatataccccagttgccactctgaatcttagctgtcctgagttcactgcaatgtatataataaggaagtcagaaggtggaaaagaggaaaagattaaatttgtaagttttttgaaagatatatggtaaaaagtagaggtatccaacagatttgtacgatagattgttcatttaaggaccaggagcggtggctcacgcctgttatccagcattttgggaggccaaggaggggcggatcacctgaggtcaggagttcgagaccagcctggccaacatggagaaaccccgtctctattaaaaatacaaaattagccaggcgtggtggcacatgcctgtaatcccggctactcgggagactgaggcaggagaatcgcttgaacctgggaggcagaggttgtggtgagctgagatcgcgccattgcacttcagcctaggcaaaaagtgaaactgtctcaaaaaaaaaaaaaaaaagattgttcatttaaaaatcaattcgattggccaggcacggtggctcacacctgtaatcccacagcactttgggtggccgaggcaggcggatcgattgaggccaggagttcaagatcagcctgggcaacatggtgaaacccccgtctctactgaaaaaaaaaaaaaaaagtagccaggcatggaggcatggtggcacatgcctgtaatcccagctacttgggaagctgaggcacgaaaatggcttgaacccgggaggcagaggtgagatcatgccactgtactccaacctgggtgacagagcaagactctgcctcgaagaaaaaaaaaaaatcaattagataagtgagagtgtatattcagggcaacttaaatctatgctctcagattaaaaataagatttaattacaattttttttttttttgatgcagggtctcactttttgctcaggctagattgcggtggcacaatcacagctcactgcagcctcgacctcctgggctcaagcaatcctcccacctcatcctcctgtctacctgggactacaggcacatagcactgcaccaccatacctggctaatttttaatttttttttttttttttagagacaggatctcacgatgttgcccaggctagtcttgcactcctgggctcaagtgattctcctgccttggcctcccaaagtgctgggattacaggtgtgggccatcacacccagccaattttgaagtatttaatttttaaaatgaaaaattgattagataatagttctccctcactacaggtgaagtctgtttttatttatttgttcaatgggcttctttagaacatgacatagaaggcaatccttggtcaaattaaggcagaaacaagaatttattaggttctgaacataaataactgtctgtgaactggtaactctctaattaagcataaatgtgaaaagaagaggattagctcttcttgaggagttggaaatggaaaatattacaatttggagaggtagcttgcagaaaccgtacagttttctctgcttatatgccccagcgttgggagacttgaaaggaatcaccaaccaagttaatgcaataaatttccatatatagatcaattggatgttttgtccccagcttcctaggcctttaataaactgaattgttttggtatcactggatgaaaggttctgtaaaagttcaaagtattgttatttggggcattcacacctgcatgtttaaaatgcctttgtgcagaatgtagtccaatctgctttcaaatcagaccttcaaagaagggtagattcatccatgtgacagatccccttaggtgcttctctaaaagaaaaagttaagctagcaggtctacccccactcattatctttgtctctttgtgcgtaatcatcaaaccgcacctctgaaaagaagaccaagagaaaactttagtatctctttgctggagatgcaaagcaagatatagaaggaactggaaaatagttcttaagtaaatacagggggaaaacggaaattgagaggacgtacttttcgctaacagttgtaaactaaaaataaaatttgaagcacgcctgcaccctcacctgaatggacttcctccttggccagggcactttaaaatttaacctgaaagactgatttaggccgcaaaggaagtcagacatgccttattttacccctccagtattaacatcaccacagaccttaagtctgataagaaacatttaggatctcttttcttggaagcctgctacctggaggcttcatctgcctaataaacctttggtctccacaacttttatcttaacccagacattcctttctactgataataactctttcaaccaattgctaatcagaatatgttgaaatctacctgtgacctcgaagccctcccccaactttgagttttcccgctttccagctttccagatagaaccagtgtaaatcttacatgtattgattgatgtattatttcttcctaaaatgtacaaaaacaagctgtagcctgaccaccttgggcacatgtcttcaggaccacctgaggcagtgtcacacgtgcatccttaactttggcaaaatacactttctaaactgattgagacctgtctcagatattttgggctaacacaatgaatatgaaaaaacttttttgttggcgggggtgggaggtgggacggagtctctctctgttgcccaggctggagtgcaatggcgcaattcggctcactgcaacctccacctcctggattcaagtgattctcctgcctcagcctcctgagtagctgggattacaggcacacgtcaccatgcctggctaatttttgcatttttagtagagacagggtttcaccatgttggtcaggctggtcttgaactcctgacctcatgatccacccatctcggcctcccaaagtgctgggattacaggcgtgagccaccacacccggccaaaaacaactatttttaaagagcatctaagctcagaaatcacaggcatattacgcctgccactaagggagttagttccattgaaggatataattaagagtgaaatgaatggtgtgctaagcacttagggatagtggttcacaaatttgtctgttccttaaaatcaccttggggggcaggcgtggtgcctcacacctgtaatcccagcactttagcaggtcaaggccagaggatcacttgaggccaagagttccagactagcctgggcagcgcagtgagatcctgtttctacagaagataataataatcacctggaaatttcttttttttaatgcagctaatgaaggaaaaaaaaatccgaggttttgaaaccaactcaaagacaacagcgatattcaagcataagatgtaataaaggttgtacactagatagctagatagccagaataaaaaggaagagatagttacaaaaaatataaggaggataaatgtataggatttcataactgctaatcatatgattttactgagtaggtgtaaaatgcttctgataatgtgtgaaaatttataatccttcgtattatatgtaggataaacataggttaagacctggattctaaggctgaatttaaggctagtttatctccatccttagatttcctacatttcatttaagagaaaatgtcctgtatattgaatattcatgaaaatctctgaaaggtgttatgcttattcttaacctcttaaaggtgtacactgaatgtaattaaatcatttttgctggctctggttcctcatgaacatctgcttttgtacttccctgtcattcacaaatgcacttaggagctaatgatctatgaggacttttttttcccctacagtaacgagcagcaaatctggctgcactttaatttctcatctgctgtcccatattgtctggtggtcagttcatgatgttactaagcttggctttattggcatcttttgtgagctgctgctgctttttccttggcaaacctgattaccaagctattgcattgagcataaaataaaggtaaattaattcaaaataaaagtgaaggttgagggcaattcatttctgaggtagacctttaggatatgagatgcataaagtgaacaagatcctacaagtgtttacttgacttttctgggttcttttcacctacttactgattttgaatagtataaattcctggataattaatctggataagtaagtcgtcactgtacctctagagaaaataaaatcaaccaaaatatgtttaattctgtgctctgggtttcaagaaaacaaaaatgaataagatatagtcctacccccaaggacttgacacaatataattgtacatgtgcaaaagaaactgtctaggtgtggtggctcacacctctaatcgcagcactttgggaggctgaggcaggaggatcacttgagcctaggaatttcagaccagcctgggcaacatgatgaaaccttttctctacaaaaaaaaaatacaaaaattagccaggcatggtggcacatgcctgtagtcctagctactgggggagttgagataggagggttgcttgagcccaagaggtctaggctgcaatgagctatgatcacagcactccagcctgggcaaaaaatcttaagtagtctcaggactgtaccacagagtatcgtaagaattcagaggaggcaaagaccaaattagaataataagcaatgaaggcttccagcaaacatggtatttttgttgggccttgaacactctttagatgctttagtttaatgtgccatagtcacactttctgtattgggagtgttaatgggtgataactactccagagctttaggattgcttccagtatcccagcaaagcagcccttttcaactagaaccgtttgctattacaaaagagaggtgatcacttgtgatttcttaacatttcttcactttgcctctggcactgggcttctgaaagtccaggaaagagcaatgacctcagggttttaagaccaggggtataatcccagctctgcctagctctctgtgtaatttttggtcagtaatttaacctgggttgtgttctgtaaaatgatgatattggattaaatagtacctaatcatctaactttttcctaatattttattattataaaaaaatgcatgcctctgatgaattgcctttatcttctttagtcatatttccctaagaagtgaataaaagataccaaggcaatgtgtgaattccactttttccaatctggatgtttaggggatatccttgacaccatttgctattttgagttttcaacaaagagttaaaagaaaattctggcactcctatctagtcatcctctccagttggcagaagtcttcatgtggacttgatggttgcccagagcaacaaaatattagggacagaaacatgttcagggactcgattgtataagtgactcagagctgagagaccttttccagcttgactgcagcccatacttagctaaagtgggtatttgtctattcctgtctgcatactgtgacttggagatgcctattattttgcttgctaaaatatggaagccaaccttgaaactggcagagaagagttaaatgatcagaaggcaatcgtcttcattcagcacgtctgacacatgaaagatcattaggactagcaaatataaacaagatcagggagtggtcttgggctttgaagagcacataccaagaacatcaagagaactcaatataaattcaatataaaagctactattcaaggccaattatctcttttgagttagaagagcccaatggagagccactcacgcaaatcaataccctttccttctctcagttggagccagacatctctaactatcctctgaattaaactggatttttaaaatgtttttctgtccctaaactctttaaatcctgaggtcatcctttctttgttccatcagtctggctccatgataccaattactccagcttgttaaagcagttattggcatatggtagtcatgtcttttgtttctatgcaatgtttcctggagcaagaattggagggagaagtattagccaagtcttgttgctttaagtctcctctcttcaactgtttaactaggttccatcctaattatgtgtttggttggttttattttgatacccaatatacattcttctcatttgtacatgaacaatgtcattatggtaataataacaattatacaatattactttctgtcctcattgaatgtcattatgatcaggagctggtcctcttggtttggacattataatttgaaatgaatattctttttaaatgattggaaacttagtcgtaaattcaagtggtttacaatagtaactcttatcccagtaaccacagcacctgtttagaaaaatgtcttcggatcacttgtttgcaaatgtctttttccttaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgaccttacgggaaaaaacaacatacatgtggctttattttgcctttttttttttttaattaatgaagaaatccaagatttgacttttgtttcttctctacccaaatcaaaagcagtctataatctcctgcaaagatcaaagctttttgcttactataaagtatgtgccctgcttaggcattacatggtagaaagatagcattctgttccaagaaatctctattcgttctctagttgctgtgtatatattctcttttagctagaatatggttagtaaatgagtcctgaaaatttcgctgtatataccaaaacatgttgtataccataaatatataaaatatttttatttcaattttttaaaattgtgcttcaatcaagacagaagttgatttctttttccagaaattcagagtgagcagtccagggctgctgtggctgctctaaaatcaccaagggcccagagcttctttcagataatttttttaacatttctagattataggctttgtcttcatggtctgagatgactacaagagccctagccatcacaactaagtggccagcagcaagaaggaggaaaaaagaaggaatagtacacccactccttttagaaaaggcttctgagaaatcccacataatgcttctacttacatctccttggctcaaatttagtgtctgccacaaaagagaataagacacacacacacacacacacacacacacacacacacacacacacatatatatatattttttttttttctggcaagtctctagttcagggatttcaatctcctttaagcaaatgagtcttctcctaacctctccctctggcctgcccagtctctctcgaatctcttgccatcctgtcctccttactcactttgggaaaatccagctctgtcagttttacagtctgccttttccacttccttacctgaattcctgggaaaaataatcccacatcacttcaagctggaattccaacaaagtcaagacctgtcacctcatcggactctcagagcacttgacagttagttcctgctgtgcccctctctcagtcctcttcatgctaattccaaacctgtcctctctcttaagcctcccaaaccagcagctcttcatctcctttcagcaaataacttgttgctttttgaagaaagtctgtgtcaaggcatgaacttcctcagctcctacatcctcttgccatagatgttatccataggtctcttactgacatccataatcccttcctcccttctggtctcagcggatgacgtttcccttctccctcctgctctaagtcaacccctgcatctgggcccttgatcctctctcctcccagctcccacaagtccttgcttcgtctgttttcctttctatctctcacatcttcaatctttacttttattctggctctttccccattcatgtctctcacaatcttaaaaacaatacacagcaaaccacagcaaagttcagccaactctttattgatcctttagctagttcttgatcttctcttttcagtcaagttgctctacctcctcatccctattcagtctgcagtccactgtagtacgactttctcacaacacctctgttccagctgccctcccttggttgccaatgaactcctaattgtcttcttagttcttagaggcttcttcttcttaaactctttctttgttcatttactgagtaaatatttattcaacatgtttttgttgggagccattttgttccagatgtttccacactcttcttgctgctctgaatacttcttttcactattcttcatggtctctcttcctccccactttacctcttaaatgtgagtattctagaatgttctttttgattaattggttttctcactctgtgtactctgtagatgttttcatgtacctcatagttgtattttccatcttatgaaagtgggtcccaaaactctgtctctactcagagtaggcacttccccaatttccaaatttattcacacaaaagcccaatgtccattgatatccaactcttcaaatccaatatgtccagagctggactcacatatttctttgcaaatctgttcttcctatctcagttagtgaaacacttttagccaagatcgaaacttataaatcatgaatccttctaccaaatctatctgtctgtctatatatatttttgaaacagagttgtctcactctgttgcccaggatggagtgcagtggcaagatttaagctcactgtaacctccacctcctgggttcaagcaattcttgtgcctcagcctcccaagtagctggtattacaggtgtacaccatcacacccagctaatttttgtatttttagtagagacagcgtttcactatgttggccaggctggtctcgaattcttggcctcaagtgatcctcctgccttggcctccaaagtgctgaggttacaggtgtgagccaccatgctcggccccaaatgaatacaatttttattttattttataactattgatcaaatccatgctctcttctctaacctgctaatatttccctagttcaagcactcaccaactctcccctgaattatagtactagtacctgaaatagtgtttttgaaactgtcagttgcatttagcattttattttaaaaatatgatacagaattgcgtaaaaaataagagtataaaaccacatctataatatcaaagataaatatggttttataaaattattgatacacccacagacatgcaaacacacacagacattttgccatgaaaatgtatttcttactataatttttaaaattagagaactactttcttaaatggtcgatctctgttgcacctcttcttagctctggccttccatgatgccagcaaatttatgtagttgaaaaattaatctgcaaatgtcactcttcttaaaaccttttcaagccttcccatcatccatgataaaatcagatctctttcgtgtggtacccaaagcccctatccagatatgtattgtacctcctctccagcccagcccctggctgactctttcagcagcaaactttttccacccacgtgcaccatgtttcacaactgtcttcatttacttgtactcttctcaccatctaaaactcgcttctctctcataattgcctggttcactttatctcattttagaggacacctaaaattcaagcccagtccccttcctcaggccgagtcaggctcttctcccaaacctacctctagcataacctaatgaaattgctctaaaaattatggtctatgcctctttattaaaaaaaaacaacaacaacaaaaaaaaaaaccctgcccaccagtatagcaattcttttgttataaccacacatagtactagtgtgtggttctggggcactgtcatgccaacttacctgtgttcaatagacctgaagtagggaagatcagctgactcttttacatctcttctcagaacatcttgaaatgattcttgggtgcaatataagagcaaaacatggaacagtagaaaccagcatggaaaactttttctcctatttgagaaagtgggatgaaaatgtgtctcttaatccctttggcagaagggagtaacttgaaagaagtggatgatggatgatcttctccactctgtcagccctctgagcagaatgaggaaaatgtgagaagcgataccattgctatatttgtttcattgaccattattttaaataacttacatggtcctgaacaaggacatgtttttgtgaaaaggacaacatttcttttggtgtgtccgagtagcatttaagaaaagccttatagtggtcaatgaaggttggcctttcacccgctgctactggagagtctgtgagaacactatttattcagcctcatggaaacactagggagtcatgcctgggatctgacaactgtgcagcaccatgccaggtgcacagagagttgttgtgatgaatgtcgagagaggtggtgggggatttttgttgtttttgctccttccattttctttccctctgacttgggctgtggtttcattcattctacctccccacccctatgcaagaatagatctctgatctctttctcatactttatctgccctaacttccactttccttttcttgagaggagaagaacaactccacagtgctttccttttatgttttgggctaattttgttgtgttgttttatggtcttgaactgagagctgcctcagcactcaacaccagcccctggactgtgagactaatgagaaaagcaaaatgacttcaagtaaaaggaagtggtttgtgttgtggagagaaacttggaaagaaacaccaccaagaacactaggggctttattttccctaaagcctacagttgggttaacacatttcaaaataaccggtcaatttagttaatcccatcaaacgacctagtcaatacagtaaagaggtagggcaaataaacaaaccgttttttggatgaccggtttagcttcatgtatccttcgtcttactcatttctagggaataatttcaactcaaggaaatgtgaacatctgttttgcaaactattacaggctggtttaatacaaaaatacctttaaaaaaggtatgttcatactcaacatgtttttccagctgttattaaagcaggtagaaacaatatagtaggcatagaaatcttgattataatgtggaaaaactaaggttaaaattattagcagaaatacatttcttttccatccttccactgtctgaacatctctctttcctacttcctccattttattattttctttgctttgtttctctcttttaacctcaataataacaattctgtgtgccaaacactgtgctaagactgggcatgcatgatcacataaggtaggtaaaattattattcccattttacagaagaagaaactgaggctcagagaatttagggatatgtcccatggtcattattctggaaagctgtggagccaggcttcaaaacttggcagttatatttcagattccacaccctgcagtcaacactctgctgcctccctcaaattttatctcagttcatttgttttctccgatcttctccttttcacatgttctctactctattctcttgcctttttcctttccttatatctgcctcttctttttccagtctcttccctcactccttcccttatttgtcttgtttcccattctttgtctaaatctcctcttttctctccctcttcaccctattcattcccagctccctaaaattatatcattcttccttcatcatgctccctcattcctcactgcagcatcacccagtccaactctgtcccatctgtgattcctcacttctgctttcgcaccatctctctccctaaggtagaagtggtgcccagctttaaacacaaggcaaagtgagggtatgttccactaggacagcgtgtgtcactctgctgccatacacagggagtaccatcagtgattataaagaggaatttcattcctgccagagagctcacaaattaggttattgttgatgttcatatagtttttagtgactggaaaaagataatgcctccttctatggtcactaccaggaagtgagctccatgcagcagacagaaaccaaccagataactgtgagatcccagccaagcacaatttctacatgttagtcaattgcaagaaacactgagatgtaatgtagtactttggactcatattactcaggtgactatgttttcaagcagccagtacaggacagaagagattcatttccttgaatcaaagctatttggtgacttttcctggaaacactctgaggcttacaggaagggattccagattcccaagctactggcacagagtaagcatcttttctttacatagtaattcacaaacgtccctcatcaccatatgacaatatcctcactggatcagctcggttaccagaaataactagatcaaaataaatgtcattctcacatggacacaggtggactagggtttagaagttttgggaaccatcacagttctaggcacctgaaacttcttcttttgcttgtagtaaatatggtgtctttctcaggactctgccctttgtttatttatatatctggtctggtttttgttttctagagatagttctctactctccatagtgtctgctttctcattgcctgagtttgtacatggcttgccatagcttctctaggcccaattttaggccatcagtagatttaaaaatttttttttctcttgacaccaattaccttagttgcaatttcccatttataattgcaacttgagcctacaaatttacaaatacaatgaggtaactttccactgtggttaaatattatagattattggctgctggtaaacccatgaattgcctgcctttggattagatattcagaccaggtccatttaacaattcagacatttttttaaacaatacttttttgagagtcttccatgtgccaggccctaatcaaagctcttgagatacattgatgaccaaaaagaagcattatccccattcttactccttataatctagggtccaggacaggggagatatgcactgtattaatgaaataatctgtactgaatgtaaaattccaaactgaagcattttatatgaaggaaacattctataagaatggaagcccagaagtccagtctacacatgctcctggaattttatgggaaaataaaaagtctgtcagaatggatcttttgagaagattccagaagtatgttggccaataagagaaaatgagcaagtggatgccagaagccatttcttccattgttgtgctcagtttgcagtgatactactgcagagcttgaaaggcaagtactggcttctcttcctcttgttcttccacccagaaaaaccatccttatcctcatattcctcctccaccttcaccaccactactacctattttgaggctgccaccaccacactataacatattcctccccgctctaaggctctgaatttggacctcccacatgacaggactctaaataatgactaatccattaagtttctgctccatttccaaaatattcattcaaatttgaaatgcctggggcctcttgtgtagccatggctgggctaatttctgcatttgcattttaaacaccctgaatcaggattacacctgaagactttcaaataagtgcttagatggcacaataaagatattcaggttaaaaaaaaatctaatgagtctgttgttcctttgcaaggcctagtgataggaacctcttcttggaaatatttgttaagccattctcacttgtagtcactcttggtaccaaatctgttgaccgaaaaaaaaaaaaaaaaaaaaaaaactcgaggagagagggagaaaggcaaagttactctaatgttttaactaacccatataaccacggagaaccagccctaggaaccaacactaaaatcttaaggactgttttttcagactctgaaaattctcctaaatctccattccagtatcattcaagctctttacaaccgctgtttgtccttaggctgtaacttgtgcctgaaatcccactctaaggttcccttgtggtatttttaatagtgtttgatgctgcagccagcttctctgcggtttgggagttaaatgggatacagcaatgtggtgtgctgtaatggctcttggagaaatgttagggcaaattaaattccaaataggatagcacctgaaagaacctggtcctttagtgaaagagcgtaggaaggaaggcttagagagtcttactggctcctaagtgattaagaagaaacatctaacctgagtttgaaattcattttggactcaaatacagagtatttactttaagacactggtccttaaccacctggttcttccctgtttgcttttctgcttagttaagcccaaagatgggtgttagtttaagagaaaatggtactaaaagggaggaggggaataattaacacctttgcttaaagcaccaaatcccatgagctgatgattgcctaggttaggcaatgactactaccactactaccaaacaggtctggcatctcctattcctatcctgacacccaggcccaagctgagcacaagcattgcaggattccgcagcctaatgtccgtcagcttttcctttgaacagtggttacatatcgttagtgtatttgagtcaaatgtgggtttaaggtagtggaaagacttttttctgctattgagaacagaatcaattttttaaaatgtgtatgtacacacacagatacacacacacacacacacacacacacacacacacacaccgctatatattttattttggaaaacagttttatttccagtagatctttattgaataacctatcatctacggagttcctatttaaaagttttcattggtaatggatttattccagacaggacaggttatatgtaaaatacaattcgtaaccaattaaaacaataacaaataacttgtgctgagtggttaccatgcaggtgctgggatacgctttctctctacatcatcatttcaccctctccacactgtttgaggtgtggatctattgtcattgtctccatgctataaatgagatgaggcacagatgttttttattatctccatgaaacaaatgagagcactgaagcttagagaaggagagaaacaacaacttgaaggtttagatactgtttgaggagttatagtaaaaagaaaaatgaaaagtcctctcaagttccactgaaaatcttataagtgtgtttctttcccacttttgcaatataatttttctcttctaccctcaactgaaataaggtcacacagcctatacagtatagaaccaggactccaaggtcactgacaacaaagtaaaagtcagcagttttggaaaatacatattttttttttcctagctgaggatgggttaccttcattagtgacataactatgtcacttgaatatcaattattggcttgaatatcaattcatttctctattaagaaaaagaggaaataactcagatataaatgatggaagtggctactgagttaggaaaacatttgaaaatcactttataccaagaaatcacattctggcaggcctaatatggtataggagatattcgtaactggttatcttcattgaaagattatagagactagagaataggaaggttaagtaaaaactctacaaatgataaaattttatgttaacaagtaacctaaccaaatactgtatttcgctggactttattgtagacaaacagaaattctggcaaaagaaaaacaacaaaaaataggaaatacagttactaagttaaagctcttgcatttacattataagtatttctaaatccagtttaagattgtggaaacaacaacagaagtatatgaaattctaaatgccatttaattaaagtgttgaaagagtagagatttcaacagtatcaaaacttgtgatcttcaaggatcaaagtaaaggtgagtttatagaatgctcactctaggttctgatttggccaattcaatcacaccactgcccaattcaatgaaaaatataggcaactttgtcaagcaatgaattttatcaatgtattcaaagttgaatgcatcttaggaataatttgagggtttagaaaatgtttgaggttttttttaaaaaaaatcttccaatttaactgaaaactcttgtatttcctttctacttttcaaatatagcctttgtcctttaccctccattgtagcttaagatgtggtcttgcattataaggaatatttaaaaccattcaatattttaaaccaaagacattcaatttttaaaatttaaatggaactgccatgtattcttgagtgttgtagctatacagcagtggtccccaacctttttggcaccagggactggcttcatggaagacaatttttccatggatggtggggagaggggttggttttgggatgaaaccacctcagatcatcaggcattagattctcataaggagtgcacaacctagatgcctcgcatgcacagttcacaataggattcacagtcccactgatctgacaggagataaagctcaggtggtaatgctcgcttgcctgctgctcacttcctgctgtgccaccaggttcctaacaggccatggaccggaagcagtctgtggcttggaggttggggatccctgctatatgggccagaaatgtgaaagaggtgttcagtggggagtatacttctaacttgaatacattcttttcagcatttctacttattttatcaaaaggtaattttttttctcaggaaataaagcaataggcaattgttttttatagtttttctgtacagagccttattcaattatactaccaatgtaatcctattgcactgctcaacagaatcagaataagaagaacttccaagtacaatttgaaaataaaagtatctttcaagaatttgcactgtactgcattatttgatttggaaaaaaaaaaaaatcagaccacttccatttcttgatgaaacaactaactcatttgctaactttcaactggctctcttcagtggctttgagaatgtggcacttccatcataccttgcctgtagtaccaccctagaactttttttaattgaaaatattttaaaagataattgattcgtatgcttcaaaattcaaaacgtgccctagaaaggatcgattattaacagcttcttgtgtattatgtaaacaaatcttatgcatatacaagcaaaatacatattggctagcactcttaaaaacataggaagggttgaatctgaccaagttaatatttcaaaggtgtctatcagaaaggaaaaggaaagcttcctacagttatgtgtatatttttttttagtttaaaaagaataagaacaagatattgggtgtgtatgtatatatgtatctatttatttattggagacggaatcttgctctgtcacccaggctggagtgcagtggcaggatctcagctcactgcaacctccacctcccaggttcaagcgattctcctgccttagcctcccgagtagctgggactacaggcgtatgtcatcacgcccagctaatttttgtatttttagtagggacagggtttcaccatgttggccaggctggtttcaaactcctgaactcgggtgatccacccacctcagcctcacaaagtgctgggattacaggcatgagccactgcgcccagccagattttgggtttttaaacctattgaacttatctttggatacatattttaagttttccttaactgtaaatgtgtttatgttcactagaaacaccacatgatttcgcagacatggaattatgtaggtgaaatcagcggctttcaattagggctcgataatattagatatagtataacttttatggcattcacacatactcttcagggataccctttgcaattccggaatagtgtttttcttgcttacttcagtcgatttcttatatctttaggaaagatctgcacattcattctaggtgaatgtaaaattgcattttaaatccattcattgggaatctcacttcttaaaaatcatgcggaaagatagatgtacatttttagtaaccgagctgttcagtaaatttcttaagattattttctcataacctctgtacatcaaaagtgaaaagaacctgtccccttctctctgtatgcaaaattccagagaagcaccaagaaccagaagaagatgaaagattcggaagagcacacattttccagcctgccagcctgggtttaatttcactttcccaaatatttacttggtaaattcagaaaaatcactggacctccaggaacctcatttccattactgtcatgtgggatagtgataacactatggatcattacaaatattaaattagactgtatggagaatgctccaaaagctaaattattgagtgctcacaaaaagcattcaacaaatacacctttccagttgaaaatgatcattccattaaattcaccctttattttctttgagaaaaaaaatctatgttctgcattttcaaacttacttttcatggatacatagtctgtaataaaaacagcatattaaacatacctttaaaagaacaaagacatttataaaacaataacaacaatcagcttctggatggttcccccccccccccccattaaaccctattaaagggaatacggtctctaaaagggaaatccagagacctgtgtattcgagttataaccctgggtcaagcaacttaactaggctgatattttggcttgatgtgatttatatgtaaccttttaagcaatgtatattaaatccgtactttttactcatctacttgattgcaagctcctgcaagataaactttgttgaactcaaatgttgtaaacttcatggggcttagatataaactacagacttcatcagtgtttaacaaatacttgcttaagaaacacaaagtcctgttatatcagccaattaactatgaagctaattttaataactgaaatatcatagaggttaatattcaaaacaccactcatcttttttctcattgagtattatttatttatttttgctttctggagacatacgtttaccctttatttactgtctcattttgtcatctctgaacataccatttacagctttttagttattctggaaaaatcactttgtatgaaataataggctatgatggctagaaaggatctcactgatcatcagtgcaaggattgattttagaaacaaggaaagtgaaaccagagacagccagtgactagtctcagtactcagagaggtcatggttggtcagaggtcagaactcacatctcctgacccacagcacgtttggctttgtgcacaactgactgccttagttaaggacagataattcttttctctttaacaatagaaaattagactaattaaagtcataaaagatgttgctcctttataagccatagagaaacccccgatggtttctttatttggatctgtgatctttaaagcatgtgactagcagctataattggattaaagtgaaaacatgtgattgtgaaggagttaaagtacctttgccttattctgctttgatagccagcttcaattgcacatcgtgacaagcagtgaaccaacatcaaccctgtggaattaaaactttagactctatcacaagcttttccaagttcaaagcccaccaatttattattggttccaagttctaggtctagaatcaagtcagctgggacatcaaatacttgttacaaaatgacatttgaatgagataattataaatagcactagaagcacatgaattaaatattgcctgaacactaattttcttaggtaggatattgggatgtcctttgctttatcactttgcagtgatgtgagcagtatgagatactatgttttgcaaaactgtattaattataatatttattgagtacttactatgtcccatgcacagtccaagtttttcatgtacatattattatttaaccttcactgctatgcttgcagatggatgtgtggtatattttagttaactcgctcaaggacatgcacagtaagcggtgcagctgaagtccagactgggtcaggctgactccacaacctcttaatccctatattaaattgatatatctgcccatgctatacatctacttgatctttaggttgatttattgatagtgacatttaatttttgttttcttcaaaattaaattcttactgtaaaactagtcaaggcaactgaagtttgtgtttgaataaaagtgtagagttaactgaggatttgtgtattctcattccaagatgagaagggagggagggaaggaagaaagaaggaaaagagggagggaaggaggaagggagggagggaaggagggaggaagggaaggaggaagggatggaggcaggaagtaagggaaggaaggaaggaaggaaagaaggaaacagtaaaggaaaagaaaggaaataaaaagtaacttcattcctctatagaatctctattaataaatgttattttttaaaaataaaaatacagttatttttcatgaatataaattttagaacatatttttcagtgctccttacctaactcccaaataatccattacttacatttctttttttgagatggagtctcgctctgtcacccaggctggagtgcagtggcacgatctcggctcactgaaacctctgcctcctgctttcaagcgattctcctgcctcagcctcccgagtagctgggactacaggcgtgtgccaccacgcctggctaatttgttgtatttttagtagagatggggtttcactcgatctcctaacctcatgatccgcccgcctgggcctcccaaagtgctgggattacaggcatgagccactgtgaccagcccatttcattctttataaccattatgaattcccacctagtttgagaaccactacttttgtgtggtttccaccctttgtgtgatttcaaaaaggctcgcctttaggcaaaatttagcaagaagtcaagccaatcaataattgcttgaagtcaacttttccagaataaaactgtataagggactttgaatttgaaggttacaatctaaagtttgctttgagatgggaataatacgtagtgttggggattattgtaaacctaagtgatctaattggaaattagaattgaaagtgggaaagtgaaggaggaaaaaatgaaggttggggagaaaagaaagcaatttaggagactctatagggaggaaaggatgagatgcatttcagaaacaaaatattaacgtaaacagaaaaaagagaaagcaatcatgacaaagcctaagagggctagtggaatgctagaatgaactcatttaccttcctttgatatttaggggctctattgcctgctaatttcatcactgttatttttcttacctcttatctttttccctgtagttattatcagcctaatattcattcattcattcatttacctgagttttcaggcttgtgcagagacaacagggtggggccaggttgcaagattgtgttcccaacttggaagtaacgtgggtaaggaaaaagtcacagctggccttagaagacacaagttaaccacatcccatgggtcagtggaagaaaacaagggaataattagaaaactgtgcaagatcagaagggagcccctgaagctataactgcaagaacctccagaccctattgcctttaaatccccttttaaaaggcaccaagtgaggaaaattccaagatgaatgggttacgggtctgaccttcaggaacatgtaggctgcctgccgatgtccacaacatcgtccctttcacatgcctaatacattagcgtgggccactcatttaaaatttaaaaaatttcatttagcatttaaaaattcatttgacagaagagatgtttcaaataaatagtcttcaaaaaaagcccggtctataagtctctgtaacacagcccatctgctttaggtgaagtgaggcagtaggcctggagcctcacctggttggctcttaaccacatttactttccaggagaagcctttcaccaacttcctcagaacctccaaaacaccaaggaacaagatcctgaaattgtccatagtcttaactttgttaataacagactgcatgcccctggaaaaactatttcacttctcttggcctcatcaacaaaacaaatgtggcctaaaatactttgtaagatggtttcagttgtaaacagcctgaaaactcttagtacaactaatttgggcaagtaggtttggctacagataaagaacagaaagacttagacagtggtatacattactctgaaatatttttattatgtaagtacaaataaatggatgtctaattgttacttttcaggtagcaacatttgtaggaaatgcattttgttaggaattttaaaatcactgaacagattgccatttagtttacattttcttctcacctgcagatcctgaaacctctgaacttttcttctgccacataagtcaaatatccatttatagtttttaactcttctctttggcccctaaaaatagaagatcattcctgattttaaaagtagcacttgtatgcatatatataatttttatctttaaaggaatacgctgatgattcctgactctagccagtcctttgcaaccttcaaaggattgtctccttggccctaagatgtaacattgttaaccttttatgacagaatcacgtcaaggaatattacatctcttctagttcctgtaccatatctttatgataagaatgtgtgcttgccatctcaaaatattgaccctctggtacaatcacttgtatctacttgaatacagatgtcttgttactatttctggaaaatattcagtaacaaatttttctctgaaatattgttattaaattttcttaaaaattgtttctaaccttctttactagagctcactataaggtagtctttagtttaagaacttcaacactctctgattttggtttaccattttcatttgtgcaaaatgaatgtgtacataagaatctgtatttccaacccaaagaggcattataatgaccgttaaattttccatccaagaaataaactaactccaccatccctgagtgtataccctgcccttctcactcttgtgttctttaattagacccaatgtgcaggacatgacttgactgaaatttatagccacattgagacatgcagctaaagaaagctcttagaccaggcatcatctcaaacttttaaagcaataggatcatttgacagaagtgtgactcgctatagtaattacacaggtgcaagttataactacttaatctgctcccagcatctctgttgcccttgagaagtatgatgtcctctagccaacatggctgttcatatgggactgaatctgcacatatttgaattgagtttttcaagtttagaaatgtgatactattttacccttatgtgccttccacaatcctactcctctcttaggtggatcagagtttctggaatccatcatctttagttctgcaatttacatctcagacttacatgtttctaggcataaatgcaagaatgacaacatcaaggcctatgaaacttagacttgtatgtatgtgatggtagacattgaagtttgttgcaggaaaatgtttctctgtcatcctaggaaaagcccccagtttctcagttcctcctcctccacacgacagttttttagtttttttagttttttagtttttttctaaaatggagttaagtccaggtgcaatagctcacacctgtaatcctagtattttgggaggctgagatgggcagattgcttgagcccaggagtttgagaccagcctggacaacatggcaaaaccccatctctaccaaaaataaaaataaaaaaaataaaaaaattggcatggcagtaggttccagtagtcccagctacttgggaggcagagcctgggaggttgagactgcagtgagccgtgattgctccactgcactccagcctaggcgacagtgagaccctgtctcaaaataaaatccaattatgatcatacctctctcctgttgatgtccatcagagtctgcaatgccttcagggtaaagtttaaacttccttctagaaacaatgttctgcggtaaaatgaccagggtctttggtattagatacacctggcctcaaaaaatgggtcagcccaggtataaccttccccatcttctgtttcctcatctgcataatggagtaacaaacattgtcaggaagttactggagtaattgtgtgagataccaaacataaaaagcctggcacaaaataaaagctcagtaaatgtaaatgtcctgtcttttgcctttccctcattgtctgcgacttacctttctaggttcctttctcccatgtgcatccccttccttccaaagcactcattgattctagcctgcagtgtatagtttcctgatcaagccaagctctcccacacctctgtaacttttgcgtatattgttcagtctccctgtaagtcttccctaccttcaccttttatagaaactgcagggtacctacttgccccttgagatagctattcctgaatttctcccgaatttaagcattcctcctctatactttcataaatctttcacacacctctttcatcctacaatgtcataatattagttggttttatctgtcttccttaatgtatccttaactcctgagagtggacgctacatcttagtcatctatgaaaccccagaaaatgtaatcaagctaaaatggctcactcatttcctagcaaatattggttaaatgactgaatggatgatacagggggcaaaataaatatggttttagaaaagtggcatggctgctgatctatcagtgcaaaaaggagcacacccacccactacatggccaaaaatgttgaaggcaagagactagatggcttgtgaataatatcaaatgaagttgtctttctgtaggaagtcttagacaatgtaatcttgggaggcgggtggatcacaaggtcaggagttcgagactagcctgactaatatggtgaaaccccatctctactcaaaatacaaaaatagccaggtgtggtggcatgcacctgtagtcccagctactcaggaggctgaggcaggagaatcacttgagcccaggaggcagaggttgcagtgagctgagctcgtgccactgcactccagcctgggcaacacagcgagattccgtctaaaaaaaacaaaccaaaaaaagaaaatgtaatcaagctaaaatggctttggctttccttcagtaaatggttactgtgggaatatatgtgaaatgaatatcaatactatgatgagaaacacatgcactaaacagctatacttctgatgccattctcaaatctgaaactttgcccaatttcagggacaaaagtgaagtaatatgtatccccagtgtttagcttttctcttgccatggatactaacagtgagattcctcagggactgttcctttaacctcgttagggttgctaggggctattgtgcctttcacaacacagcacctgcaactgggaataattgaaattttctgccattagctattcccagcagagtattctgagtcacatagaaagtgtcagaagcatataaattactgatacattttttaatcccatattccctcagggttggcgtttttctctcttgaaagtttcccccttaaggctgggcgtggtggcttacgcctgtaatcccagcactttgggaggccgaggcaggcagatcaagaagtcaggagatccagaccatcctggttaatacggtgaaaccctgtctctactaaaaatacaaaaaattagccacgcgtggtggcgggcgcctgtagtcccagctactagggaggctgaggcaggagaatggcgtgaacccgggaggcggagcttgcagcgagctgagatctcgccactgcactccagcctgggcgacagagcgagactccatctcaagaaaaaaaaaaaaaaaagaaactttccctcttaaaatattcttgtttaaatctaaattaatttcatagataccatttccatttttctaatgaataatactgtatcctttcctatctataccatgaagtttttctttgccttgaaaacccatttagatttatgatttctagcccccaaaataacttttgttcctatatccaattccttccctcacagttctttcacaatagcttcttttctcctgtaaaaccctacataaactccaaaaacatttctagttttggaaatcctaatccaagaggtcacatcactaacgcaaacgtagaaatctttgtaccaaaggacagaggtgcaagggaagtcgggagttgtggctgtgggaaagtgaggaggactctttggcatctgggcagaggtacagggaagccaggatgggggcagaaagaaagtttctcagtttctcttgtgtctacggttcatgcttaggcctctgcagcagccccaaggcaggtgagggtgatcagctgttccagtttgcctggcactgagggatttcctgggatgtggggcattcagtgctaaaactggggaagtcttggacaaattaggacaagttggtcaccctacctttcccttgctgctgctgtccttttaaagtcctcattcctttgaaaattgcagtgatcttcagttcttcgtgattttaactgtatacaaatattcaaagagcttggaccagcacatttctcagagagagctctacttacagtaaatgttatgtgacagagcaggatagcaaatagatgttacctggggcaactctaattgcttggtcatgactgtcgggagtaaagtgttaatagtttcttgcatatcctccaagagagtattacaaatactattctgcaccaagctctttgtaatttaatagtgtatcttggggcccttttgtatggacttatacagatcatgatctagagataatgatcattcttatttgacacatagtattgcattatgttatgtctaaaaacccatttaactctattgatagtcttgtgggtcatttccagtttttactacaattaatacaaataacactgcaggcatccttgtgcctgaacatctttgtgagtttacccattgaataaagtcttagctgtgaaactgaatttaaaattttcataaatattgccaagctgtcttctaaaaagaatatattaagttacaatcccaccatcatcacaagaaatgcttgtatttctatacacactgaccctgagattcacaaaaaacatattttccccatctaatttaattgcaaagaaaattagtcacctttcatacatttatgggccagttccctcctacctccaaagactcattgaatcaattatcttgaggagtttattttttatggatatgttaatgttttgagtatattaagaaaatgaactctcctcatttgtgtaaacttttcaaaaaattttaatttgtttagggttttttttttttatcatttagtcttttaaaatatttgagtagtcaaattcatcctttcagatggtttctggacaccctgtatcttttatgcttgtttttcctggcattcggtgcagtacctatcacaaaatagattctcaataaatgttttttaaataaatggacaacgaatgcatgaataagtgaaggatataatttattcttttcattcctcctcatgctatgtagagatttgcaaaatgaatgccaaaacatatctttgaacagaatttcatggcccagtatcttcaggcagtggtttttctgttttgttcaaaatgatgtccctatcatctgcatagtgctggcgtatgggagatatacgtattgaatgaatacataaatatagagaataatgagataaatagaacgtggattatttggagttcatcctcctgagctaatgatgggcatttctggaagtgctgggttgcaaataagtccagaccagagaggattgtgtttaaaggcccagaatctcaactgataatcctcagaagctcagatttacttttttcattccaagtaaattaaactggagtggtaagaaaaagaaaaatggttatgaccatcaaccccagaaacagggaccacatttaattgaatttataatgtccctaacatctctgctgtgtttgaaaggttaaaaatttcctagagaaaacagcttttgctactacttgccaaagtactcataaaatggactgattgctaagaacagaaaacaaaccaaatcaaaataaaatgaaccaaaaagcaacagaaataaatgtgccttaatgtagttggatgattaccacatctactctcctcagaccaccagccttcagagtaagggcacatccttccaaataagtgcatccttgtcagggacatttggtgaggtgcaaccccttcaatgtgtccgtttcctgggtcatttggggtcttaggaaaatcttcttgttggtgcgcactgaattgcacatgcattatgtaactcattgcaacccaatagctgaactcatggtttcatagctattaaaatatgccacaaaccaaaccacctgtgaggcgccaactcagcaaatgtgccttttcagaaagtagtcataaaaggtacaaaaaatgaggatgaaagaaccctgaataacaacctagagctcatacatttggagccatgaggaaaagtattccatgtaagttgaaggaagatagcagtcaggagcattggtgttgaagaccaccctcactatgagaaagggtcatatatataatgtggaatgaatcagagctaccactgtgggtcccctgttggaaaaactgcaattttggataattatgtgcaagcactaggagaaatgccagatgttagaatccatgtttaatgtgaaaattgcattttgttgtttgcagaacctcaatatatagctttctctataaaatgtgggcatatttctgaaggaaagaaaaatgccagggtttcgttttaacatcctgttacgttttagttaaattcaaaggaacatgacttttcaaagagaaaactgtctctctctcataaaatagcattaagtggttccaaacatatcttaggttataattgaaattggactctgtggaacaaaattaatgatggtttgttctcaaaggcccattgtcccgttgattttatcagttattctttgttaataaggtggtaatgtggtcttaagagcttccactactgagagaatccaaggaatcatagataagtaaattgatgtcaaatattatgactttttctctttcattcttgtactgtatctagttgcctcatctttttttctaaatctcacagtttttgatcaaattccctagggacagcttacatgctagctttatgagggaggtgagtcatgcaatcccaagaaagcaaaagtggagttgagggggtgaaaggaacagcagtagggaagaagagaaaccatgtacaaggtaatgcattactaagcttgtcagagcttcccaacaacaacaacaacaacaacaacaacaaaactagttgctaagttacaagggacattgcctgtgaggctgtgtcgtaaaacattccacatggagaagaaagggtgagcaatttttctgtgcataggtcttttgtctctcattggtcaaagtttgctccatggtacccttggccctcccagagtccctggggaatacagagcctttgtccatctcacgtgtagctggatggttcctgtcaagtcagaggccattgcccacgctaagcccgcaaggatggggaggtggaaaacatgaggcaattgcagtgataaccgctgctttactggggctgctgtggcatgcctgggaaactgggagagtggcttatgcccaaggggtagggtgggcagagctgacctggggaggccacaaacaggacctagtgtacttttctacagtatactagcagaattagaatgaatcagacaagagatttattaaattaagcttttgtaatgtcctgatgtagtgcactgtattttaatgctgtgtcttctgttgcttgagttcctaatttgtaccaggtgttgtgccaaatgcttcaaataaattaccttgtgaaatcctcacgactctatggactccaatttacaaatgagaaaactaagacttaacttgcttatcttcaccaagctaggaagtggcagagttaaaatttgaatccaggtctaaagccattggtcttctatgccatagaatcggcatccattttgctactcttactagaaaatcatgaatcctagctatgaattgtagtgaggaggaaagttttttctgtttcatgtttatgaaaaaatctctacctttttcattttgtgtttcatgcatgtgacagcattttcagagattttgtgtaagagtgtgtgtatatatatattgtatatttacagacagaaaaaaattgagattaatttttcaattctctaagtcataagagaatggaaaaacagaaatggacaagcagaattttttatcccaatgtattctttgacatacactggtcataatgctaatgttagcaaaagaaataaagaaatccctggtgcaatgggatgattgaccttcctttagcagaacagtgttgacttgttaccgttgtcaaatcagactgaacacattcaacaacatgatcatttctacttgtgggtttggactgacaaggacatttctagtatatcttgttgacatcaggttaataagctctaagcaaagctgaaaatgaatgctacttcccacaatcaagtggaaatgttaatattatcaacatgtcttaaaggccatgaagtcctatgcctgtatatgtaacaggaatagcaaacaggaacttttcttaaagggaagattaaactagtgttatttttatgtattcgttaattgcatgctccccatttttaaaactgtacctgaaaatatactgtaataaaaaattaaatttgaaatattataccattgaataaggtcctctggatagttttgagatttaatattctttatttcaatttacatgtatactgaatcacgtaaaagttatttaggtcagtacttccccacatttgttccttcatgacatacgctgataactatatttctacgaaaactgcagtaaataaaggatgtggcttgtgttcagtctcccacccactagcgacaagagccaagggaaatcaatagcttggctcacctgtcatctccactctttggcacaccattgagaagtctaatatgtgcaaagaaaagttaattttactttcaagggttatacctttgcttattccaaagaacggtgggggagtgtaccagggccattattataatgtatattattaaactttttacattttaactgatttctcttatagtaaaattaattatatattagctttggggtatacaaaattgcactttgataataatatttaggaattggcaactttgtgggcaaagttgtgggaactatcagaaaagtaaaaaataaaggtgggacccgaaagaaggaaggattgtaggttggagccatacgcgactagaaactaagacatgtatccttaaaaaccctcaaatctgtgttctgatgggaaaaccctgctaagtcaatggttcccagactttggaatttcaaaacaaaaaactgtgaggcccaacatacaattaccaactcttcatttttgccaaacaaaactattttcaacagaacacactaacatatactggaaccatgatttcatattatgacatttattttccacattctatatacttttaatatgcaaaacaaggacaaaaagggcagtcatctcccatggggggcttagaaatctctcattaatgtgtgtgtgtgtgtgtgtgtgtgtgtgtgtgtgtgtgtgtgtgtgtgttttaaattggccttattatttctttaaatttaaccaagggccagtaaaactcccttttggaataccacacgcccgtgctgttcaggaatgattatgataaagtcattcatgaggacatagagttatttcatatgctctcaaaaatgacttgcagtgcgaaacacagctactattggacaagacaacaacccaactttatataacaattttttaattcactagtacttgtgtatcagtcaataaagtacctggtacttgtgtactaggcactgggatggagttggggatacgaaagtgaaaaatatagtcacaatttctaccttatactctagtaggggaaagaaaaacaaaatgtatgattgaactgccttaagcaccatgaaggcaacatacaaattgctgtgagagcatataaccaactcagaaatcagccttaaactgagacctaaaaaggactccccctgtgccttttgtatatttaaggcatcttttttatattctagaaatacaatatcattgagcagatagattccaaagggccatcttctagctggatgaaatagaaaagggcaccccttcctcaggctaacagccctgcctgctgagggcatagttaggtgaatggatcatcactaatgaatggatggttttaaagaagggaataacatgaccaaatttgcatttaactttactcaatagtctggagtatttaaatatgattaaaccttttctttccattcacttgaatgaggcagaagggctattcaggaatttaaagttgactaaggtattgattgggtacaaaatttttactaggtaggtaagggcaggatgattccattagaaacaagaactttttctccagtgctctgggaagaattgattggttcagggctaaatcaccaagatgaataccttcttttgattcacacacccttttgacatctgggtttccctgaatcatatgcaatctaggacttacgcagaccactccagtttcacttacgaaatttgggttagccaacttaaacagtcatggctgtaatttgcttctgagttaaaatgctattattattttatgttatttatggattcctgcaaaggagaaagcatttttattttgataaattttgttattaatgaaattaactcaattttgtagtaacatagtatacagtgaaaatgtgctttacgagatgccgtggcttgtctctcaaatggacaatgaggctttccgaaacctttgtgcctttaagtttaaggaattgatttggcgtcttatctcagtgtacacaaagcttagttatcacctaggaaatattggatgtttgtctcagggagaagagacaatttttgagaccacaattaggttttgtagctatttgacatccaattataatcagatactcagtgaaacatgcattcataatgcaggccaatgatcatatatttggcttagcttttcactagaaaaattctttaaagaaatattgtccttccaattttagtggtactgaggaacagctctggttataaggggggaaatactatatgtcctttgttcaatcttactaatctttattaattttatgattttccccatttattttttaaaaatcattaataaaattatccttgattgagtttctcctatgtgctaggcattgtgataggactttagtaaacatcatctctaaccctttcaataaccctgcaaggtagggtcatattttatagataaggaaactgaggctcagagaagttatgtcttgaaattatatagtagcaagtggttaagccaggtttccaacacaggtttgtctgactctaaaaccagcatctgccccatctcctcaccattcgcgaccagaatgtgatgcacgtctaccaaaaagagagtagcaaaaggtgatttatagaagcagttacagtcctctgaagagaaggcaaaactattggggatagggaaaaagtaactataaagatcatatttatataatcgaatattaacttaatggcttgaattaggtggcaaataaaatatattagcaagcaatgttacaaaccatggtgagagctatgtagtagatgaagcagaatgatggctgggctcagggagctcatacatttggaacccagataaatctttgctccttcttcccagagcccatcatcactttttaaaaacacgtctttgctgggctcagtggcttacatctgtaatctcagcactttgggaggcaaggcaggaggattacttgagcccaggagtttgagaccagcctgggcaacatagggagatgctgtctctacaaaaaataacaaagaacaaaaccatctgaatttcatgcattccaacatatattattttgttccattctacttaataacctttacactagttgtgaaactcactgaaaacaaaggagaaactcattataattcatctaaacattcctgaaatatcactttaatcaaaaaattaagaaatattgctcagatttaaaagaaaaatggaaactcccttggcaagtgggtttgaggtttggtcattaggttttgaataatcaggagctatgtgttgtagtaggaaaagcataccatttagagagagacagctttagtttgtcagtcctgcctcttaataggtggatgaccttgagtaaagcatgacgcagcctttgggcatcagtttcctcacttaaaggtagaagggttgaaccaggtgtaagctgctgttcttccatgttatgattctaaatagttctagatggaattatgttgcacatttcatatgttgttaaacagcttctctctggaacagttgctcctaatctcctaataagcttactatgggtcactcagcaatcttcaagagaaacaaacattatttggttggtggataccaagacaattctgatgtgtttgtgtcaaagattggtcagatgaaatctaactagacatgtatcattccatcatcaagcgaaatgaccttgactctaaacatcttaatttgaactgtagacatttcccaaatgctttagggtagatttggaccataatacactccactgtaaatggagaaagttcatcatccccataataattgcccccaaactgctaggtaggaatgcatactgggtttagtatgtattaactcccttgtgaattcagcttttgagagcagacctcttaacaagtcatgagtatttagagtgaaatatttaattcttagtgatactattttcctattctgctattattattcagctatgattattttccttctcctcccaacctcctatttctttttctttattaaaaaaaggagaggaggtgcatgctgccatctggggtgaatatgggcttcacgtggggacctgggcgctggttctgatccagagagtgagctaggagcacttacacaagagggtcttagccactgtgtcgggggaatagccttatatcaaagactgaagccttttagtaaaacctgaagaataatcagaagcagcattgactagtctctaaccttggttgagggacacacacacacacacacacacacacacacacacacacggctctgaaagctcagacacggaggacacgctgtgatccacttagccctctcttctccttcagggggtccttgcaggacagaacgctaaggaacaaagtcttaactggcaagctgccggcagaaggagactgtctggtggattgcagcgctgattaggaacggggagtcctttgcgtttcagaatccggtccacattttgctgagagcccaggcactgtgaataagaggagcctctgaggactggtttctgatgtcgcactaggcatgataagaatgccattgacgtcagcagagtcatcatcagggagaatggcaccccagctcttgaaaccacaccaagcaattgcagtgcttttgaaaattaaaagccggtgctggagtgtggggggtgaggtggggggtgggggggtggggagggaaagaagcaaagagggaagtcgtggctccagctgaactcttctttcttctatgcgtttcctgtattttaaaaaggcaggctcacggccctcctgtgcacacgcccgctcactcacacacactgctgcctgggctcattaacctaaattgggggaggtgggggaagaagaaagagagaaagaaggaaaaaaattaattctgttaacacttctgcatgcacataaaacaaactgtgccacccaggtgctggacagaggccctgagccacataagcctctgagaatcaaattgctgaggtaaaactgatatgctttaaatgtgtgttgatgaagagattacaagggaggaattaaacacttcaaaggagctactacaaagcaacaatcactcttcccccatccctcacacacgcacattactgtggacgcttgcatgtttgtgtgtctgcctgagaaaatggcaaagttggtttaggaagggaacactgcaggcatgttgtgatttcagctttcacaggcagctccaagaacatcacctccagctataattcaacggttacctggactggaaaatgtcttggaggttacgaagtctttgaattctttagtgtaaattgtctccgctttgaaattccacaattgatcgaatcctttcattctctttcccactcctaattgttccactctaactctccacccaccgccaggaatatgaaaacaacatagagtagaactgatgatatcagctgtataacacgctttattttacggcattaatgggcagctttccaagtccataaaaatcttttgctgatctgattttaatatccatattcttcagttatactagaaagaatgatttccgagatgtggaaatgttagccgggaaacaaaaggacataggcacataaagcaaaatctggcaggaaatgtgggtttaataaattgaattatgtgaaactcctatttcaaatggactgatactagaggagcagccctcgagagatatgcacagtaatgattcttcgttttcaaagacctgtttctttttgaaaaggaagaagccctgaacagcattcctttcaaatacacaaaggtagctaaagtacaaccttctcctctttcctatttgttctttaaaaaattgtaaaaattatattaagtgtgcttcttgtgatagagtcaataaagggagaaggagtttagcaaagcacatttactatatactcttaacccgtcttgcttactgtaataatcgaaagaaagatggctaattgtcttgcaggaatttgggttatcctctgaaaggatacaagtaaatttgtaacttgggtcgtattggctattttttgttctcttttgctttcatttttgttttgtctgaggtttataaatggaacccttctttcctttcttccttttttccttccttccttcttcccttccttttttcctttcttccttgctttctctctctctctctctctctctttttttttttttacaattgtacttaaaagaataaaggattctgaaaatcagttccaggatccaataagggcctagattgtatatcacaggatcagagccccttgctctcaaatttatgattgtgaggatgtattattgtatttgggggatcaataagcagagccagagccttcacacaaggctccttgtgccccctcccccgctccatcccatgaggttaaaaagcactgactttgactttaacactgtgaacaaaatacagaacaactgtttcaattcccttcactatttctgctatgtgcctagattagatgttttctgacctgtctccctaagttgttcctgtcacttgtgtctgtcattcgctcccccatcgcatcctgcccaaccctccctgtctatgattcgaattgctctctgtccagatcatttcctgcagtgaaaaacgaagaaagactttctcccttcttcccacctacacattccttttgtcccccaagatatcccttcctcttgcctggaatcttcccaggccttaattgattgatttaggccccctttgcaccaggcaccctagcggaagcccagaaagccccaagagtctggatgtgttttggagagcaggctcaggttcactgcacactaatttgcagcaggaagtgctaggaagcccgatgagggatgggaattagcaaataaggttggcagtcaattgacagaggaagcttaaggaagaggatcattttgaaaaggaaaaataatttaatccttttcaggtgtgttaatttctttcgtggaccaaattaccatggacctggaatagttgagattttccctaaggtctggctgtacttcatagggaagaagcaagggtaagtgcagtaaatttgattatggacaccagtctaactctagcttaatgagccatggaaacaaaatagctcaatctcttctaactgctgtaatgcaacactaggagcattgagagcactgtggttttggttacacaaatttgtagtacaggccttgcctcagcatttgaacatttcagcaagagagctgaacttgcttcgttcttcatgtagcagatataagtcttttggaattaatttgaaaaaaaaagaaaagaaaagaaaagaaatgtacccagaaagcaagagatcttaaatgtatccaaaacctagaacaaacaaacattaacatttgccataattactgtgggtgtttttaataaaaatatatagatagataattttggaggttgcatttccccaccatcactgccagcctcatttttcttccatcctctccagaacaacctctgccataaatttaggaaatagtcaacctgttcacattttcatctttttactatatatgttcttattcacaaacgaatatgttgtagttataaaaagtcatcagtatcttttagcttatttttttaaatgcaacattatgtttgttggatcattttactcttgtcccagtgcaccctgtaattcccatgaattgacaggtagcgatagatcagcagtagtaaagtaactgatatgggtaggttaatagaatgacccttttaagaagggatctcaaagagggaggctaggtaagctacaaaattatcagggcgaaatgcagtgaggtagaagtgaaagcagcttagagtcagcctgggctaagataaatgaggagtggagctgcagctggaggagcaagagaatatggtctactcgagtataaatcaagcttgctggtgagcagtttaggactagctcctggttttacagcaagactttttatgtgatcttgaccaaaccactgcacttgattgctcctttctactccttggtcctcacgtgtcaaataaaacccctgaattgcagagccaaaatgcaaacaaatagaactcctcactcaacctccctcagtttataagtaaggaaatgaagacctagtaaaacattataacttacagatacctgtcagggcagaaccagaagctggacttgggctaggaaaagttgttcccccctgattacattttccaaaggttataccttttccacagtttctaaggtaacatgttgattgacttgacagttgtagaaatattaggaagtggtataaagccaagaccatgtttactaaacagtgctgctcttttttttacatcatacagatgagaaagctggtgctcagggaatttaagcaacttgcccagagtcacgtagcttagaagtgttagagccaagatttggaccccagtctttctcactttcacagacttgcttttaaccactgtgttatgctatgctgcctcagtataagctcctttcaaacaaaccacttccagtctctgacatgcaagcccagaagttttcagatttacaatggcatactttttttctatctgctaagtgttagatgtcacggtgtctgcaatggagtagagctttagaaatgaggataaaacatttggtttgatgttagtattaagaactccaatatccaaggcaggaaacttggtaattaatattttaaatggactggaggggtcacaggtattaaaatcaatattttgatggcaagataacaatgtaggaacaaataattggagatgtttagcaaaattatgaattaagtagatgtataaacggcagattatgaaagggaaacaaagattacctgggaagagttttgtgttttagtcaactgaattaccagaatgggcagaaaaaggaagtatcaaagaagggtctgctgatagaaaattaaataaagaagaagatgccatggaaacgtttttagtgcaaatacactattgctcatggctgaagacagaaagaagactatgtgtgacttccagatgaagttcaggcatagaggcagggctaaataaacaagcacatagacccgagaattctcgttgattgatctttggaaattcggtataaatatgatcagttcaaccatgccttagctactggatcaaaggagacatctaccggctttgggagataggaatctggaaaattgacagactgaaaaaaccaaaaccaaagaaaaaaaaaaacaaaaaaaacagagaatgcagaatgccattttaaaaaccctaagaggctgtgtctgatgttacaggactctttgactccattagtctcaattctaatatttaagttaagtgattgtgggcatagaatttttttcaaaacctgtttcgaaatgaaggcttcccatacattgaagttaaaagtggtcttgagaaaagaacttcttaataggtaaggggttttactttggaatgttgaaaatgtttggaactagatagaggtggtggttgcacaacattgtaaatgtgctaaatgccactgaattcttgactttactatttttaagtttatgtgatatgaatttcacttcagtaaattatctttgttggtgcataattactgtatatatttatggggttcatgtgatgttttgttacatacacaatatgtataatgatggaatcggggtatttacggtatccatcacctcaagtatttatcatgcctgtgtgtcctctttctagctattttgaaatatgcaatacctgttgttaactctagtcacctaatctgctatggaacattagagcttattctatctgtgtgtttgcacccattaatcaatctcttcatcccctcccctcccacctacacactcctcccaggctctggtatctatcggtctaccttcatgagttcaagttttttagcccctgcatatgtgagaacatgtgatatttatctttctgtgcccagtttatttcacttaacataaagatctccagttccatccatgttgctgtaaatgacgattttattcttttttatggctgaatcatattccattgtgtataccatgttttctttctttcttcctttctttcttgctttttttttttttttttttttttttgagatagagtcttgctctgtcatccaggctggagtgcaatggtgccatctcagctcactgcaacctccgcctcccgggttcaagcaattcttctgcctcagcctcccaagtagctgggactacaggcgagtgccaccatgcccggctaatttttgtattttaagaagagatggggtttcaccatattggccaggctggtctggatctcctgaccacgtgatccgcccgtctcggcctccaaaagtgctgggattgcaggcataagccactgtgcctggccgtataccacattttctttatccattcatctgttgagggacccttaggttgattctccatctttgctattctgtatagtgctgcaataaacttggggatgtaggtatctctttgatacaccaatttcttttcctttggataaatacccagtagtgagattgccggacatagtggttagttctatttttagttttttgagaaatctccatgctggttttcatagtggctgtactaatttacattcccactggtgatatgtaagagttcccttttctctgcatcctagccagcatctgttattttttttttattttttattattttttgcatttttaataatagccctctaactggggtaagatgatatctcattgtggtatcaatttgcatttccttgattattagtgatgttgagcattttttcatattggacatttgtatgtcttcttttgagaaatgcctatttatgtcctttgtccacttttaatgggattgtgtgcttttttactattgagacgtttgagttcctaatatattctgaatattattcccttgtcagatgagtagtttgcaaatattttctcccatttaatagattgtctcttcactctcttgattgtttgctttgctgtgctatacagaaatttttagttcaatacagccccatttatctatttttggtcgtgtggcctgtgcttttgaggttttagccataaaatctttgcctagaccaatgtcctgaagtgtttcttctgtgttttcttctagcagttttatgtttaagtctttaatccatcttgagttgatttttgtatggtgagagataggggtctactttcattcttctgcttatgggtgtccagtttttccagcatcatttattgaagagatctcctttccctaatgtatattcttggtgcctttatagaaaatcaaatgtatctatcattatgctctctgtctactctaaatctatcagtccactctgtaaaaatgtggatttgtttccaggctctctgtattattccattggtctatgtgtctgtttttataccatgttgcttttgttactatagcgttgtaacatatcttgaagtcaggtagtgtgatatattcagctttgttctttttgctcaggattgctttggttagttgtgctttttttttggttccatagaaattttaagtttttttttatttctgtgaaaaatgacattggttttgatagggattgcattgaatctgtagattgctttgagcagtacaataatttttttttttaaagagaaagggagaaagaattgggcactaagtacatcagagtagatgtttatcaatttttttaaaaatggtcttggctaccataaactgtgatgttcttgagagcttacattgtgtcttgttgattttggaattgttgatactcaaagtgcctgacacatagacttgattcatatgtatttaatcaatgaatgaatggataactctgacctcctcttagtgaagtgcacgtcatggggctaccacttgactatatgctgtgggatagatcaaagaaaggtaggacacaaccttgaacaaaattaaagtaaccttcagcttgtttataaaaagtgttctggtggagaaataatgaatcttttcagattttagagtgttgctgatttgatttcaatttgcatttttaaccatcagtctctgtggaactttagtttataggtaggacttttgattgagcttggtggctcacacctgtaatcctggtgcttcgggaggccgatgtaggaggatcacttaaggccaggagtttgagaccagcctggggaacagactctactaagaataaaaaaattagccaagcagagtagtgcatgtctgcagtcccaactacttgggaggctgagcctggaggatcccttgagcccaggagtttgaggttacaatgagccatgatcccaccactgcacactggcctatgcagcagaacaagaccccatctcaaaaagcaatgacacacagaaaaagcagaattttaatttgttctgctcttgtctctagcacttcatatccatttctctgaatatgaacagtgggaaaggtagtggaattgaaatggatcatagaatgtttcctctactgataatttttactccatttggagtatgattgaagagctaatgtcaagatgcacagcaggactcaatgattgaaaaatagtgttactgatgtaaaagtcaccatattttaagctttctttatgatagtcttccattatttcctttgtcatattagcaccactggaaaaacacaagttatacgtagggtagaaaatgtaatgacaatttggtgttttataaacaataataaatcagctttcatgaaattaggctatgtcctctgctctggtgttagaacttacttttgcctgagctcactaaataattatttcaatttcccagataaatgtacttctgtggacagaggccatatgctggtagcccctatacaatatatagagagcataaatttcctcttctctcttggtatttaaaattaggatttttataaaatgcattttattcttattttgcttctccatcattagaaagattcctggatctgtaaaccaaaaataatagtaataataatgataataagattttggcaatttaaagagaaattcactttcgtgaatatggtcacgccagctatcttttgaaccttaaaggaggcaggaagaacatttgaattaagaattttggagtattacaacctcatttggttctcagaagctttttttaatttcatcttctccacgccagtttatacaattctctcatgcctcactttacttttatatcttttcttaaaaacagtttaaattgtatcctccccaccccactttatacaattctctcatgccttactttacttttatattttttcctccattcttccttgtttcattcattcactctcccaagtcctctggcctaagttttatttgtgtggtattaagcagagaccaacagaacaactgtgaagacttcttggggataaaccaggtttcacttgaattgtggtgcgtctgccattggtgtggaagcagggcagaaagaggacagaggcataccagcaagtacagacatctaaacacaaagagaggagaacaacctcagggatactccctcagtgcctgggaagaaagcaaaacttaaagtgctcatagaattgtaaataaactctctcctctttgaaatttatgttcgatggttgctgtgtagttgcaacagtgtcataaagtccatgaggcctattttttttgagtaatcaatattgtggaaaagtgctagagcagacctaccttatataaattaatttgtttgaattgctctattcactatgaataaatatttattggagtaccttctatatgctggggacctcagccatgagatacgcaggtggaaaaaataacacttaagcagcttattgtatagcagagaggtggttgaattgatagacaattaaaatacaacgtgttgaaaggcctgttaaagccacagggtcactcagtggcaggagggattcagtcagcctgggccagccatggcaagtaagtggcctttggaaagttaccaaggtaagacatacctgatacgttcaagaaacaattccaaggttcaataaggccagaagttaaagggcaatgtaagccctggaaactgaggctagaaaggtagaaggatctctttttaccacacactgtgccgggcaccatgaagaatacaaaatagctagctattatggagcctacactttaatgtgtgtacatagatacatgtccatgttggaatttaactccttgagaggtcatgaattacttagtcccggaagcatttgaatttatactggaaagctatagtagagagttgacaaaatattttaaatgtagtaagaagaatttgacaatctattgtgtggtatgctagcaagccagttctccttcctccttttctcaccatcccaccacccctcacaaaaaaaaaaaaaaagttaaaaacctgatctgcagtgtttgtctatggccatggtgcaaatactcctcccatggctggttccaagctaccactggttcaacagttcttttgcagaattcttgaatctttaacacttaacaagatccagttccagcatattcctgcaacagcgattctgcagttctcaatgtcaaataatagaaccaaaaagtcatataagtactacaaagaagaagagagagttgagagccagcttagccaggaaatgctccagggggaagtaaggcttgagttgggacttatagataagaaatgtaaataaaaaggaacaaacactcccaccgtgatgcacaaatattggatcatgtatgtgtgtgacaagtgtggccgtctgtagtggagggtccaggtaaaatttaggccatgaaagccttggtctgtcaaactaatacattttgttacattaaagttagtagacagccattaatggtttttaaaaacagatggtcatagcaatgttttgacaaaagcaatttttaaggaagattttgtttttataaaaagttgaattattgatagcagtgagaccccagaatagaataagagacctgcctcatgtaagtgagagtaattcaattcagcagtaatcttggaaatttgtaacttctgtggtgagaaattgtatcctgggatgttgggtaaagccactgtgaagccaaagaaattagtggctaaacgtagagaaattaagatgaaggaactggcacatggagccactgtgtactataaagtatttttattggtatttagtcttgctgttattgttgctaatgattgtattgaataattaccagctgttgttagttatttgaaattaggtgcctaaagcaacctctcatcttgcagaaagtcatctttcttgaaactttttaaaaacttgcttgaaacatggagacttggaatgggacgtctatcatagtagcacatctgaaatccttctcattcctgctgtcatttctgtcctttcgcagtccactttgtcaccacccccaccattccttgttctgcctgcaatccagctttccagtcactttctctacttcttgcctggctgcagcgtcatcatttaaacagctctgggttggtatctcctttcaccagaattcctgcagccgtggagtacgtgcagagcatcttccttttgaccctcttaaaatgctgaggggtgtttccgacacacattgctttgtaattcaataatagggcagttgtgggttctttttattgcagttatgctgatttttaaaagcactctgagtaagaaaggaaaggtagtaaaatatacgtgtacctcgatgctcattgatcacgtttgcacatgttcttgccaaatgttgtttttaaaacctgtctctgcaggtctgagctgtgaaagtttgggaaatcagggtcagaaggcaaaaaaaattcgtttgtatcatcgtcatacaatataaattacatgtagcatatacatagaaaacaatccaagggatgagcttcctggaaatcattccttcttgtttactctgattatataatggggaattgtatgctttatacaattttaatttcttgaatatatgtgctcaaaaaacattataatgtggttcagtactatatatgctgaaaacaggttgctaatgaatttggacaaagattcccattttatttcctgtacgtttacacattttttggctgtatattatatttactatatatatttattaggactacagcaaacgctaattcatcgactgagataagaaatgtgttttccattaataattataaatctgccagaagattgtgagatttacattgttggggatctaaacaaccaaaatcattgcaaagttattttaaaactattattaattatttatgtaatcatagattatggcttgcagaagactgaagaaattgttcaacaaaccatgtaggttttgtggaagagcagtagactttgataagtaagctcagagtggtccattaaccttttctctatatgtacattatgtgttgataagcatgatatctattatacctcaattattaataacaatatacatcctaactattaagaacttagcctgcaaccctaatagtgtcccctttcttctagaacatagatcagcataaggaaggaagcaaaggaggtctctaagcactcaaaatagatgttcacaatgttcactcactgaagataatgtaggtcattagccagagaaatgtatgttcatattttagtgatgattcatacaagcttggtcatgtggttctaaaccttctataattggatgaagcaaattaagaaaggctgggtaggagatttcagggaaagtcacaactgatattagccaaatgtcagctgatggcctgaaaacaacaacagaaaaagaaaatctacaaaatcatttgaaaaccacagacatagctatttggggcctttttgaaaggggcaataagctcaacccatctttggaaacactgagcgcatcctgtctggacaactgagtataatttttggtgttcaaactgatgaccccaaatcatcaaaaaatacaaaattatattttgctcaatctgtattgctcttctatattatggtaagatttctgtttagtgcacttaaaagtaagactacccccaaatttaatccccatccccttcaatgtctcctcctggacattgctccatctatcgccccttctccctctttctttgacctactctttgatggctgcatctccttcaaaactggttgaagttcctaaggaaaaaattcccttcctctttgatcctgtatcttccatcagttattaccacatatctctattgattttcgcacccaaacttctagaaagtttacacttatcattttctttttcttttccccccacttattcctctacccccttgaagttagcttgcagccccaccactctgttgcaactactgctgtagttcctctgctctcccaattgccaaaccaagtagatatttttcagttcatttctcatcaagtttctctaagtcaattgccagtgtatccctctcaaaaacctttccatctttgcatgaggtcgtacactctttcttttcctttccccccacccttcctttgacctggggttcccaggatcccattctccattcctgctttcctcactctgtgtgtcttccaagactgacttgtgcattcttattttaattaccacctgtttgctgaaagcccctaaatttatatagaaatccatcttaacctcttctgcaaagcttggaaccccaatatttattggaaattcccaactgagtatcccatgggtttataaaattcttcatatccaaaaccaaatttagcttttcctctaaatttgtgcctccttatatatctcagttggtgacactacccagctatcatgttcagaaaataaaataaaaatacgtcataaaagcatcaaaactctataaatttatccatgtaaggattgccaccattaatatatactttaaatccttccaaatgtttgtatacttgtatatatttaaagggatcatatttggtgacttactgctataacacatttttcccatttaacaaaaaaaaaatttttctgcatcaaagtatacttcaaaattatttttgtagttgctcatgttctagcagttatttaactaataatgttaaacatttacatcatctttgcaactttatttctcttgttgcttttttcttaagaaatgactattgaaaatgacccccaaaagggtatataatatcagtgataaaaattagctcttggaaagggaggagagaattttctagtgtatggtagtagcagtaacagtggcctagttacactcaatatctcaatatgtaatgccatttatggacagcttactatgtgccacactctttaaggactttgcataatcctcaccacaaatctgtgagattggatacattattgttcttatttcatagttgtggaaactgaggcccggaggagtgaaatactaggccagggtcacacaagtagtaagaaacagagccaggagtccacctttggcagtctgtttccaagattggtcacctaacacaatgcttatctgccttttgttgtaccctagggcatcctttctaccagagtgtaccacttcgctttatgtttcttagaataaaaccaataaatagtgcagttagttagctaagttttcagaaattttgatagatagtgtctagagaaacaaaaaagacacaatttctaagatgtagtaatgaatgtttcattcatgtcggtgattattttgatttgttgatgtgtttttgataacagagtaggcaaaaaacataccatcaatttaataatggaatcctaagtttaggtttaacatgatttttgaagaagaatcaatgtgcaaatgttgatgtattttcagagttatggttcagaaatgtgaattattcaaatctcatatcagaatctaaatttttaagaaaggaataatagaatatagtaggtcccctaccatcaattctacttctgtacccctattttatcattcatatttggcttgctagtgaagatgccttgtatctgttgtatcactgggtataatgtctggcatttgcaggtgtgcatgcaaggaaggaaagaaggaagtgagggaaggtggaaggaagagaacaaggagggaagaagggaagggtagacactttgggaggccaaggcggttggatcacctgaggttgggagtttgagaccagcctgaccaacatggagaaaccccatcgctactaaaaatacaaaaattagccatgcgtggtggtgcatgcctgtaatcccagctactcaggaggctgaggcaggagaatcgcttaaatctgggaggcagaggttgtggtgagctgagatcgcgccactgcactccagcctgggcaacaagagcgaaactctgtctcaaaaaaaaaaaaaagaaagaaaaaggaagagaaaaagaaaaaaggaagggaagggtagaaagaagagaggaaggaagggagggagggttgaattatagatttccccaactgcctcccacacaatgtgctctaaccataaattcttcatctcagttgctcaggccaaagcttgagaatatccctgtgtctactctttttagaacatctcgtatctaatacattagaactcctgaagcctctgctctcaaaatatacccagagcccagcatccttgtcaccatctccatggttaccatcctattgcaagccaccatcttctctggcttggatgattgcagtggctgtctaataggagaccctgcatctcctcttgctgcataacagtctattcaaaagacagcagtcagtgcaaatcatgtcattcctctgctcataaccttgcaatggctcccatttccctcagagttaaaagtgattattgtggcccacaacgtgtagcccaatttgacccctgtttcatctctggtcttctttttaactcttctttctctcattcactcagctccagcccattagcctccttgctgatcttcaagcacatcagtcacacttccattttaagaccttggtgctgcatgaagtgctctttcccccggtatcttagggccaattccattgctttaagtctttgcttgtgtttcatctccattaggccatccatgaccatcccattttttaaatgcatcgcacattaataccattcccaatgtctgctctattgtatgtatgagtgcttgtttcatagcatgtctatccttctaacacataatttactatatctattgtttattatctctctcctgtactagactggaaactaccatgtggaacaatcttcgcctattttgttcactgatacagatatatatacacaacagtgcctcagccatgctaggttgctcagtacattcttgaataaatgaattatcgatgtactcagttctgttacacagatgatttggcttctttggtttcccattaagagccttgttttctttgccaaataattgaaagtttcactcagaagataaggaacatcaaagacctcaagctttgtggtcttggaaagctgtggctttggtctctgtctcattccccttgggatttagaatagaaaaatgcaggtggagaacacattcaaacatcccacactttatcagtattttaaaagaaagaaagtatggctttttttttctcaaaacaatgtcttagttataaactgaatttgtataaatggccagttgtacattagggcagttgcacaatagaaagcatccagggaacaatcataacctcaagagcctattggaaagtgggatcctaaatagctttctatgatctccctagaaaactgtagaatttccccagagaataagccagcattttgttgaccattctgcaattccaggatcatgcttgcatagtcatagcttggaaggaggcaaattgaaacaagttgaaaatctgcaggaactatccccagtgagaccacagaaaagccagaagaagaaaaggtgggatttggggtagagaacgagccacttctcactagtttgcatgaagcattgaatatcccaagggagaaaacattgaagttctatgagacaccaagaaaagtgtatagattatcacagcatatggatagaggtcatttgttccctccctccctttaaagaaaagtagctttgcaagccacagtttaggaacaaatggactttttgacatagttcaaatcctcctgggtgtggaggcattgacaggagcaatgtcataaattggttaaaggttgcagtctggaatcaggctgccctgaatcccagccctgccatttactagctgtgagaccttgtgcttcctaacctcagttttcttttcttttcttttttgagactgggtctagctctgatgcccagtctggggtgtagtggcaccatctcagctcactgcagcctctgcctcctggactcaagcgatcttcccacctctgcctctcaagtagctgggactacaggcatgcaccaccatgcctggctaatttttgtatcttttgtaaagatcgggtctcgccatgacacttaggctagtctcaaactcctaggctcaagtgatccacctgcttcagcctcccaaaatgctgggattacaggcatgagccacggtgctcaactaacctcagttttcataatggtaaaataggaataccgatagcacctcccttggtataaggattaaataagataatctacatagtgcttgaaacaatgcctaggcagtgttcatcaacagttagctgtgtgctgtgtacatgctggagctgctaccttgtagaaattttaaatttaaaatggtgtgtagttggaggttaggagttactaggggtatcgcctagggaaagacagttggttacccagacaggtccttacagagtagtgttttccctggagaattaactatattccagaatctgtcctcaaccaagcagtctcagaaaggtgatcttgtcacagcctctgagtaagctgattcaaactctcaaaagctcacaagagccttaaagccagagtatcagctgattccttaaaagctacaaagtgttttggccttgccaacatacgcattctccctcttatgggtaggtttagaatgctaaatagtacataacatggatttagaatagacagatttacatatgatcagaaggctcagtggtcatagttttgagggcctaggacatgcatgtgagcagtagggagatcatcacaggaggatgggcacactctcgaggctcatacaggcgctccctctctccatgggcagcacaaggcaagtctcctttgtctttgatttacttgccaaccaccctcattctaatgggaactttctttttccaaatatgttaacaccttcaagtaattactgtcagcgtccagcctgggagtctcttggacacagtttttcataactctagatggatctcataatttgcccctgaaagatggtaaataattttacttctcttacttctggactctaagggggatacttcactcttgctccttgacctctcctctctagatcccacaagccaaaaattgttggaaaggattaatatgagctgggcccaataggctacagcatgcaccagcccctaaagccagctttaggattgggcggagtgtcagcccagcttccaccccacttggcttattcagcgacctcctgcaattgtcctctgctagcccttggcagatcagaaatgttctaaagattgacctctattactttgggctttccttaacttggcatccatgaaaagatccacttaaatgctccagattcagtgaagtctccttatcagagcttcttatagcacccatacttttctttctcagcatttattatgaatgtaatcaaatcatactttgtgcatgttttgttgtggttgctgtttaatgactattttgtccatgaaagaaggaactgtgtttgttttatcactggtttatccaagggactagaacaatgtatggcacatacaggatttaacgaattttttttaatgattaatgcccctttagatagtgtttttcatctgagtgcctcaacttctatgtgcattatgaaactgatatagtgggtcacaactatcagtaagaaaaaaagaactggaatagagtagaaaaagatgagaatgtatcacgcatagggaataacttttataaatctgtttcagtatggataggcaggcctacaccacacacacacacacacacacacacacacacacacacacacacacacattgagttcctatgaatttgttttttttaatttctttcttttttttttttgagaaggaatctcactctgtcacccaggctggagtgcagtggtgcgatctccactcactactgcaacctctgcctccctggttcaagtgattctcctgcctcagactcccgagtagctgagattacaggcacctgccaccatgcctggctaattttttgtcgttgttgtatttttagtagagatggggttttgccatgttggccaggctggtctagaactcctgacctcaagtgatcggcccgccttggcctctcaaaatgctgggactacgggcgtgagccaccgcacctggccaatattttttaaggtaagaattttgagaaacactgtcctaggttccctctaaaaccgaagatatcaccctatgttcagccttttagccctaatccttttcttaatcttccctatgaccaaatattaccatgcacacatgcacacacatacacacatgtgtgcacatacacatgtacactaatccatctaaagtgctactgttaaggaggagcaatagaagaggtgattcagggaatggtttttgatggttatttacttttataatagtttttatttgtaaaaagaagaaacctagagttttgtatcctaaacaaaatttaggattaggatacaaaataataaaattcaaaataagtcttgactagtgagtgtagaaggacagtgctacatctgaatctccagttgggtttacgcattttgtatttatcaaaaggcagtagtgatttaaaatgttgataaacactcagtttcagttttctattgctgcaaacaaactattccagaaagtgatgtcttgaaacacaaccattctattttgcagtctgtgctgggctcagccgggcagtcctgctggtcttacccatggtccccaatatggctgcagtcactccagtagactggaggctgggcttagctgagatgacctgctttctttctttcttcatgtagtctcatggcttttctctctctccatgtggattcctcatgtgaactctccagcaaggtagtcagaatttcttccctggcaactcagggctgccaagaacacaaaagccaggctttcttaatgtttaagcccagaactggcatgtggccaattttttgtgttctgttggttaaagcaaaccgagtcaagaagagcctacacaagtagtaatattacaagtatgatgaaatatcattctcttcttagaccaaacagcatattcctccctccactcttaccctctataatgttttgcttttgggagttcctttatatgaaatgcctcccctctacttctccttctactgaaatcctactcatcctgaatccagctcagagctaactcagtgatttccttcatacatctctattatctcatcctggaaataatcactcctgccaggtgcagtggctcatgcctgtaatcccagcactttgggaggctgagacaggcagatcactgaaggttgggagttcgagaccagcctggccaacatgatgaaaccccgtctctactaaaaatgcaaaaattagccagacatggtggtgaatgcctgtaatcttagttacttggcaggctgaggcaggagaatcacttgcacctgggaggcggatgttgcgagccaagatcgtgccactgcactccagcctggatgacagagcaagactccagctcaaacaaaaaaaagaaaaaagaaaaagaaaaatgccctcagcactctcatagcattatgtctatatttcatattatgtcttgacatataactttacacacacacacaagcacacacacacacagatgtagcttgcttttagattttaagttgcttatctaagattgggtgatcaataactgtttttttcaaaaaacattaactggttttctatgacttttaaatgacagctctaaataattataatttctcactagtttaaaaaggcaggtggtgggatattcaaaactattggagaaaaaaagctgatgtatgctaccagcataaaacaacaattgccctttacatcttcagaaacccctgtactgtgcagtcattttcaaacctggatttttgtcttgtgttttttccaaagtagtatatatttaactttgtaaaatggtgtggtgttttttggttgttgttgtttttgagatggagtttcattcttgtaccccaggctggagtgcaatggcgcgatctcagctcaccgcaaactccgcctcccgggttcaagcgattctccttcctcagcctcctgagtagctgggattacagtcatgcgccaccacgcccggctgattttgcatttttagcagaggcagggtttcaccatgttggtcaggctggtcttgaactcctgacctcatgatccaactgcctcggcctcccaaagtgctgggattacaagcatgagtcaccacgcccggcctaacatggtggtttttttcctacctaatatgaagatacttaatgtcttaccttggaaaaatatacatttcaaccagtttatattttacagaagtgactgagaaatcataagcctttgtgcaataacatcatcagtcaaacacataagcagattctaatctgccctctctatcaattagtcttaaaactacaagttgttcctctataccagctacacatgtgcattggtagtcttaaattgtgatatgagcccttaggtagttcacacctttccaaaggaagctcagtgaacttcctgaaactgtgtaaagaattgtgtgtgcagtatgtgcatgtacattatctgtatttttctgggtggatgatccagtatcctcatcagagtcttaagtttgagaaacccaattatatattagttgtaaatctgtttactttcttagaattcttctcacattaaaactaagattatatttctatttcataggtaaccaatttcttctggagcaactggacacttacacgaacacttccatctgtctttcatctttacattttatttctaggtattactagtgttaggtcacactccctcctatggggagattctctatcacatctctagaacttcaccaatgcaagccttcttaaattgacccactcgctactgagtctgacccctgggccagtcacatcggtgcttgttagaaatcagaatcttggaactaaatcagaatctgcaatttaacaagatttctaggagtttccacagcatatttaaagcttaagaagcacaaagctggtgcatctaataccccactttctgctttttaatcttgcaggatttatgttttaaattctttataatactattaacaattatcatttgatttctattttcatatcatctgacagttttgattaaatcctttaacctcaggatttgtaaggggtaaggggagtgggttaactaactgatctgattatcaaataatgctaccattcaggacttatgcatagtttctgtgattctcaatagaatttgatggtacctacaacctctactccttgttttagtgtctatgtttttccactgtgcttaaaaacatttaaagggagaggctggaaaattattttaagatgaatactataaatgaaataactaagattagaaaaggcaatgataatactgaattacattggaaaaattcagtttacaaaactctgaaaagttcctaaggcagaattttgctgccccggtttctcataatagacccagcagttctaagttaagcacacatctttttggctatatggtgtatataccagactatcctttttctccaaaatttgactttcatctcaaagagtttaaggaatttgtgacttggtgcgtttgatgtggcacagttccacatgtgagggatggtgatttggatagcacgacagaagtacgtgccaagaataattggcttctgtcttgcggaacagctcaaatactatgtgtatcacagtatgtaatttgggtgtacaaaatgcctgtagttcaaagtgctttactcctctgcagtggcaagctgagcttcctgttggctgattccttatgtttgcagtaaacaggctgggtgcagttagaaagaaagcatccatctagtaagtgcattcacatcatccttcaaatgccataggccttagctccaggacattttctgcctgtctccttccctccctcctttctttcttttcctctctccttccctctttcctttgttccttctttcctccctccccttccctccttttcttcctagttccccctttctttcctttcttctattgaataaaacgcaaagtaattctttttctacttactttgattcttatcagctttcttaagcagtttccttgccgctgttgtgaattacatggggctgtggtaaaatgtggcacatttcaaggctatgtatccctttagattctggttcagtaagcttggaaataaataggagagcttacgcttttaactactagcctgcgattcgtataatcatgttagtttgagaaacactacagtaatcacacatgtaagggctttggagtaagatggaccttggttatccaacgcttactgtgtgactttggtaaattacctaaacttttctagccttggattttaatgtgtaaaagatagataatactaactcagtaattctttatgggttccatgagacaatgtatttaaagcacccagcatactatctggttcatagtttacagtcaataaatgttaattccattatttgatcacaatgtaagactattgaggtttaattttgattgttttttcaaaagtttgtaatctgttaggaacaatttctaaagtaaaattcagaaaacaaaaccatcaaaatttaattcagctaacatttttgaggttctatatagtctcgaacatatattatctaattcgattatcactataaaccctgtgtatagtagatattatcattcccattagtggatatgcaaaccacggctgtgggatagttttacatttagtaagtggcagatccaagtctagacagcccaggctggttctctttatactctgcctggcaacatttgccttcatcactgtctgttttcaaaagtaactaacctctacatccctgctcacacatacaaatagctctaaaggtacaaaataaagctaattttctgagcaattcattttattcaaatcagtctaatgatctgttccatgaaaaatgattatgtagctcaaaggtcttcaaactcgtctcaaaccaggggtcaggcagatcatattcacataaagggagaagcttgccagccagaagtcaataaagattcctgggactggggtgacctggaagctacaacctgtttaaaggagacagcttctgcctagctccaggctagtgctcaagtgccaggatgtgggctccctattgtcaaatcttttttttttttgcttttttaagactggaagaaatccaatatttaatgcgaaacttcccatttttgaacaacgtgtgtgggccaaacaagtcacatctgtggaccagatctggcctgaggattgccagtttgcaatcttgacctaattgcccttaattcttcacttctcttgacctggtaaatactccatttaaatgagtattaggtatgttctgggcccttttggactgggtctttgtaatatatacaaatttcaaagactgacctttagtttttcaggttcagaattgattttctcagaacccaattagatcaggtgctgtcactgacactcagaactcatgaactttatgcaagagcaagaacatgaattagggaattcacagtgagaaatatattgacaagtagacaggataccatattggccagatcagttcattctgtccttgtagttcagccccttgagaaacaaacttctaattagaagctgctttgacatatatggagtcagaaactaggaactgtagactttaaagggctttcctgcattgggttttgagattcttcctccttttatggtagtcttaacattcggctgttaagtgttatgctccccctccccaggcatgccaagtatatactgaccaagtgtcttctttatttagctaccatatgagtggttctcaaacccatgcccttgttaaaacacagattacagagccctatgccccacaaattctgattcagtacttctggggtgggtcctgagaattttccttcttataagttcccaagtgatgctgatgctgatgaactgctggatggggaaccccctttgagaagcactgggttcctctatcatcttcagctgacaggctttttcccctttgaagggttaccgctattgtctgtgtctctgctttaatatgctaatatagcattatggtcatatccagatcctgaggttggaacctgggtcttagaacaatttttaaattgtttatatttttaaaggtatttgatttattaaaactatttgattactttatttcatcaagtccaaggtgccattgattataaaaacatgtctggattttagaggcattaaaaatgtaggggccaggcgcgatggctcatgcctgtaaccccagcactttgggaggccgaggcgtgcagatcacctgaggtcgggagtttgagaccagcctgaccaacatggagaaaccccatctctactaaaaataaaaaattagccaggagtagtggcacatgcctgtaatcccagctacttgggaggctgaggcaggagaatcgcttgaacccaagaggcggaggttgtggtaagccgagatcataccattgcactccagcctgggcaacaagagcaaaagtctgtctcaaaaaaaaaaaaaaaaaaaaaagtagggaaaaaattaacagtttcagaggtactgcaaattagtaaataaagcctcagtttggggcagtctcccctggattatgttgtatgtgtgtagctcaactcgatgggcacagttgaaggaaggattccctggtatgtttgttaaacaaacataaggtgaattttaagcctcccttccccaattcttagtggaaaagacactactggtactgtgtcctatggctgactttgtcgtctaattgaaatatcttattattgtatgcatcctctcctacttaaatgtgaccctgaaatgccagatctttcctttggaatgaatcttttttgtcttattggactggtagggctatgcacttaaaaaaaaaaaaaagttgattattagactcactgtttccttggccagtcaggaaaagatatttaggacaagagtttctcaattgtcctcatccagttttgcctttatagtgaatttcaataaatattaccatgcctatgtaagagggtgactggagaggcagaaattctatctgactgtccacttctaactctactattggaaaacctgctaggggtttttgtatttattatttttggaaaaatcattaagtggattcccttagctatataaacataaggcctgtcatctttttctttggagaaagagtgtgacaaaatttcccccttcttattaaaagctacccctcctcttggtacagtttgaggatagcgtggaccaaactacctaagaattcaggagtctaccaggagaaaagagactttctcactttgtcccacaattagaagtactgaggaaacccatgagaatggatgaaaaagggcagtcccatggtgtattgtcgggagagaatgctgatacggcgggccctagagggattaatgtatctgtgtagaggaaggggaaacctaagctgcctgctcaagaagagcatcttagattgttgagtgagggctgatctttactaaatgagttaaatcaaagagccaaactcttggagtccaaggctgggcatggagacccaaaccagcaaggacacaggtctggacaggaccattgttcactgtgataccacatggcagtggcagaagccttcataccaattgccgtcctctctacacctgaagtttagaagcacgactctgctttagactgaataatccctgaggttcttgggttatttgaaagaggggtagttttcaaaaagagagatattagatttcctattgaaagggcagccctggtctccagtgattaactggaaaaacaaaagagatataacaatttttacatctaagtactgtgctagcttctgtggatctagaatcaaatgagacaagatgtagtatgacaagcagttagactctcaagaaaatcattcaagtctgtttaggaaaactgacattcattcattcagcaaactattgagtagctcctgtgcatcagaacctgtattcacagtcaactgaaataaacacaatttctacacgagtggagttttccaaatagactaagatgtcataatggactgtgtgtagagtaatgttcaagttttttttgtttaagcttccccatcccccagaaaatactggatatatatagcaaaacctttcatggataataattgacatataccttggagaccatttggaatctccataaacgaaagaagaaagggcatttcagacaaagggaactacatgtacaaagtcacaggcatgtagaaaaagatgaatgtttcggagtaacttacagtatgtagggcgcaaacagaggaaatggcaaggaataagactatgtgagaaagcaagttagggcgaccttattaaaaagtttatagacagtggcgcaccgccaaagatgtagaaatgtggcttgctgtgttctgtattttggagcaatcactcgggtaccctgtgttgtgagtaggggtgaaagaagagaatcagtggaaccatgggaagcagtttgggagataggttggaaaaatattggaatgttctaagcatgacattgtgaaagaatgctagaatctttttcatatgaggggtgttatggaaaataaagaaagtattggccctgccctcaagaagcttggaacataaaagaagtaaaacatgagagcagggcctaataatgtatctcaaagtgctgaaggaagcatatgcattatagaagttctcatcctggactgtggtttgttgagaatgcagctgggtggagtctgaggaagtaagtgatggccataatcgaagaagagataagaggtaagagcaatggcttaaaagcaaaaaagcctcaaaacattcaaacttcctttgtataatagtggatgttattttgagaatgtcagtttcaggagataccataatcatgtgtttgtctgtatttaaaaagccaccaccataaaagatctagagtcactcatgaagttcaagtaccaatttttacccatgagtgtggaacattctgctcttttacaaacagtaactcgtactgtcacattttgcggcgcatctctcattttgttggttatttagtggccatgtaaacatgtacatgacttgtggtgaatatggtgattctcactttataaccaaagagggtggatgttacagcatatgagcagttatgactgtaaagcctgaagtgtgagtcacagggtctgacccaggtagtaagatgtgttatttgttcatgttggttagctgaatttcctgggctgacctcactgaagtttgctccagtaaagaaccggatctttactgatagatcaaggatctgaattctgcacctagttctttggctaaccagttgtgtcctttgggggaaatttcttaatctttctgctctccatttccctttctgtaagtaagggattagaccaaattccatccaggattgagaaattctatggtgtgacaaagactgctggtgctgactgaatatccttacagatttgttcatttagtaaccaatataataaagatgactgactgaatcttaattatattgggtgacatctgcctagtcaaaagattgcatttctcaggctttctaagagattgatgcagccaactacatgttagcagagggagctcctgcctagaagcactcacttttactcctcctcccgtttgtgtagtagtgatttggtgctggtgctggctggagcatcagtagccatcttgtaacctaaatggcagaattgagaatggaagccatgtgttacggatggtggatcagaaagataataggaacctaggtccctgataaacatggtgtcaccattccaaccttgacctgtttctagattattttctttacttttctttttcctttcctcttttttttttttttttttttgagtctttctctgtcacccaggctggagtgtagtggtgtgatcagggcttactgcagccttagcctcctgcactcaagcaattctcccacttcagcctcacgagtagctggaaccacaggtgcatgccaccatacccagcaatttttttttttttaattttttgtagagatgaggtctcactatgttacccaggctggtctcaaactcatgtactcaagtgatcctcttgccttggcttcccaaagtgctgggattaaaggcatgagccaacatgcccaggctacattttcttaatatgagataaaaataaacctctttcttattgaagccattactagatgcctaattcactttctaactaacatattagcatcagattatctttatgtaatttccattgctaggttttctctttgcagtattggagacaatagcttaccaactagcttgggaacttcttagtgctattagagtttcaacacaatttaccaaatttctaaaattatttagttattggatatatgaaaacataatcaccatatgtgaagaaaaaaccaccaatgtttagtacaaaaattgggagggggaatattatattagagaaagtttattaatccagaaaaccacagaatttaaaaaatattggaagttgggaatttgggagttaaaggtacatttgatctttggttaatggcaagttcacattttataataggatgtaaaaccctatttctcactgcacctgtactttgatcttcttgtctgtcattgcaatgtgattatgaggattactgggtcactctcagcctaagatgtttttgtgacttaattttctaggagaggaaggggatcattaaaggatatcattaaaaggagagacacaaggcttgtaattgaccttccttgaaagtagtcccatctggaagattttatcagtaaacatttatcagtgtatttggcttttaagcagactcttctcctcttgtctttgaaacaaacaggcaaaggctaaaaaggaacacgttagtgctcaaagtttgcttcttgtgcatgctgaatgggaagaaaaataatatttaagaaaaaagctttcttctaagttaattacatgattcttttttcagttttgcttcaatgtttctgtttgccaaattttaattggcaagttatggtgttcttcaatgattatgccttggtgtgatttgcttggatgtgtgtttagagagtggagggtagaagggatgagatttttgtgaaatacagtgagcaggggcttagaaaacctactgcagttctctgtgtgactaagcccagcactagtctgaaacttcgtattgtacttctctggaatgcaataactatcgtcaggaagacaaacgttgctgtggcttaaataaaataaactgacatgatgtattaccagtcaaaataaattacccaaacagtcttgtaaagttgtgttttttggtcatcagaactgcctcattattcatgtgtctgtttgtctctttggttagttttgcttgttgacttgcatgtatcaatgatcacaatccttgtcatttgccaattccatataaactttcagaaagtgaaaattgcttttaagaaatttattttgaagtttctacttatatttacccacataatgcccctcactgatagccagctttgtttcttccattcctttgagaatactccctagtgaatttaaagagtaaaatctgatgttgtggattataatattatacaccaataagtggttgttacacacttgtgtccacacttggtaagatgtccttgtggatgtatctcttctatgtatagtatattaatggctttatccgccatttaatgtggttcccatgaggtttaggtagaccatagatactgtttcaattagaacacttcatgaggatttagtttctctgtctatgggtcctgtatctgaactctccatttttattcttttgtttgttttttgttttgttttctccctgatgcctgatatcagaagaactctccatttttggcttcattctctgctctatccacatgagacagaccaatgtctgcaatctagtgccatacctttccaggttttttatgtccaacaaaaaaagagagcatctctttctagtagctcccacataattaagggtatagcccctctcctgaaccaatcagtcaatcacagtggtcccatctgaccatggggatgttccccaaaggaaatcagggtgttatttttcaaaaggaagaagaaataaatgctggaccttcataacaaccaattgcccactaaaagtgcagtcatatttcttgatgaaatagaacctctccttgtatactgggctccatgacacattgatcatggttagctagaagattctgaagtcttattatccactttgccagttacatttatttgtagctcaaggggactgttaagggaaaggggagcagtgctaaaaacaaatcccattccaatattattaaaaaaaccattgctctgcccttcctttattcacaacttagttcctcatcctcatcttccccagctcctccttttcagctatttcctctgtaggtgcccctaccactaactcccacagattcccccatctcctttgaagaaaaaagctagatgctcccactccctttatttcttccacagtaaccagcttaactagcacacggctttgtacatggtacacagttaagtaatatttgtgaaataaatacggaacacttaagggaaataaaaagcaatctatcctcatcaagaatgagctgagaatccctgagatagcctatttagcagcttagcctgaattctgttttagtttctgtttctggaaactcttcttattttaagaaagaatgattcttataattatttcatatttgttgatattatccagtcttagccagttatcaaaatggtcttgagaattaggaggggaaagcataatgttataaacatttcagcatattgtgcaagtaaagtcctggtagtctgggtaattctagaactcgagtagacttgaagtgatatcagaggaaagctattacccaagtttactgcttgctaatcaggcagccagcaataatgagatggtacaatagaaatgttcaaagtaaggtttcttggcatacatagctatttaattattttatttctgaaagaactatagctccactgttacctaagtttaacctttaggcatttaatataatagtatctctagtgtaacagagggaatcaattactatgataaaccatatcctttgtaaaagaatactataataccaagaaaggcttttgtcttcatctttttagtttttggttattttttgttccattccctttaggtaagaataagcatctagaatgcctcattatgagattgttaatgaatattttccattgtaatttaataagcctaaaaataagaagatactcctctactttgtcatacaagatcgttgaatggtgggtcattagttgatagcaaaaagtcactcattcttagttatgtttctgatgacttgaaaaattgagtggcagtatacaaagtctgagcaaaactgacttcagaatgagtatttggctttgatttctcatggcatcttgcccattgagccatcttttcagaggtctcagctgtatgaaaaaatagtacttttttttttccagaaacatgaagtctggcaatctttataactttgtgcagcttgttgattcccggattcaatggtgttagtgaaaaagaagtctcaggagctccagagtctcagaagaatgacaagaagacccctaattcttgcctgtctctatatttagtatccaagttggggataaaagctagtttttaagattttctgttcagaaatcttttctatatactattcagaggcagccctttgtttaaacctttttttgtctcaggcatggattaactgcaattggattctatgttaaaaatgtatttttttgaacattttgtaggcatcactccagtattttctattggtgaaatcctgatctttttctgtgtagaaatttttgtgaccttcttttctttactgaagttcccacatttcatgatcaattgtcttggtctgcatttttatccattgccctgggcacgcaatagaccttttcactccagagatatgagtccttcagttctgaaatgtttgctcttattcattgataattttatgccctctattttctctgttctttcttccttgaattctcattatcttagttggatctcctagatcatatcctttaatttcttaattgttttcttccttttttgtctttttgttttttggtcttctagaagatttgttcacacacatttttattttccaaccttactattaaaatgtttattttggtcatgatttaaaaataatttagcactctcattctctcctttttttttttttttttttttttttttttgagacggagtcttgctctgtcaccaggctggagtgcagtggcataatcttggctcactgcaacctctgcctcccaggttcaagcaattctcctgcctcagcctcccgagtaactgggactacaggagcatgccaccacacccagctaatttttgtatttttagtagagatggggtttcaccatgttggccagggtgatctcgatctcttgacctcatgatccgcccacctcagcctcccaaagtgctgggattacaggcatgagccaacatgcccagcctcatcctctcctttttaatggtatatgttcttatgtcagaagtgtgttttatctaaggtcacagattattatcctcttgaggttttcctctgtctctctctttcctgtagatttctttcttcagttgatgtttgcttcttctagtttctcttcttcattatggagagtttccttaagaggctgttcattcttagttaaaagcaagacatatacaggtgcatatgcacacacacacaaaacaaagcaacaatgacaatgatggcaagaaacaatgtcagaagttctgtgatcatggatagggctcgtcaactgtagggttgcactgttgcatcataggttgttcaatcaaagccggtgtgttctttgaaatgtttccccaaggtcatgattagggggtaccccactttctgcctgcgagatttgcgcctggggcatataactgactgctaatgtctggggagcatgacaaataaaaaagttgggtttcttattgcaaactctataggctttcaaataagcacctatttcgcaacctgcagcctctcctagtttgctacagtgcctagtatcatcagtttcaaatctctctagccgatttcctccaaaaaagaaagactccgcttccagtaggtaagggaagtagttagtttggatccaaaggctccatataattttaatacactttcagcccctcgctaaactcctgccttccttaattctgctgcctccaagcagtaagtctttctggattcgggagaacacattagtccactttctcttggaatttactctccgtaaccatttcctcgattatgctaaggcacttcagctattttctgatttcaaaaaatcagtagaaatctctcctttgctgatcttgtttcctttattatttgtgcctttgtgggtgggtgtgttgtgtttttattcctttactttcacttcagtgaagtatcagtaaaagagaaagaagataagcaggcatgatttcaccctctcttactggaaatccaggggaacgatagctgaggaggaaagtagcttggaagagcaccttagagtagaaaaagacgggagaaggtgagtttacaaaagtacagcaagatgatgatgatgataaataaaactcaatgcgtgctcactatgtatttgcactgtgcaaagttctttacatggattatttatttgtgtttttgtaagaacacctcaggaagtagctattgagacacagagaagtaatatgacttgtttaggttagtaaatggtagaggtggtattcaaattcagatctgatttcagagaccatcctctcaactgccacactatcttgcctcctacaaattgcttaagcagggatttaaaatgaaaccgtacttttacaaaatcatttttcatgtccattatttaggagtctctctactctatcaaaagtattaattgacctatttattaatatcttagtaatgtaaaatgcttttaggtttgcaaattagtaagagaaacttcttcagattaatagatgctgtctttatgaggactgcatgagacttatgtactcatcattatatacacccacagacgatctatttgaattctgtactcttactcttttgttaaataaatgtactctttctaactatgttttaaatcatctgcaaagagatggaagctgtgtgtatacaacagcaaacatctggaagaaaagaatattcagccaaagcttgttaaagagattcataagcaaagtatgcctttgaattatgaaaatgaattcatgtccaacatcataaagaactctgacatgtctgtttatgtttcaaacatggcttagagatcactgagattaaaattcaattaagtgtgctctgttgtctttgctgtcaatttcagttaaaccagacttgtttggcagttttggggagaaaaatcttcagtgttttaccttgctaacattttaccatttggactttgtgttttttcccaataaatgcatgtcatttaaggagatgcttcatgttatacacacctggtgattttcatcagcagttgtacagatgaaagagaagtaaaagcccccaaataattcatcttttaggctttgtaaaattatcattttataaatttttaaattgtgaaatataacaaaatttaagaaagtatgtaaaatttaaattttaagtttaacaaattgttctaaagtaaatacctactatgatcacccctcagaaagaccctataatttcctgtttcatcctctccagataggtcaccactatcttgactttacttttacttttcctacttttctttatgatttaccacgtatgtatgcatgccaaaacaacagttcaatttagtttgttttgcattttatgtaaatggactcatcttgtagatactcctgtgttttgctccttttgtgcaatattatagttgtaaaattcatcaatgttgtatgtagctgaggattgcacatcataatatatatcatgatatatagcattctgttgtataaaggaaccacaatttactgtccaatcttctttctttatgcagttgaacatatccagtttggaaatattatgaataaagatatttcgaacacttatgtgcgtgtatcttgatgcacataagcgtacatttttgtgggggaatatacctaggagtggattcatgggtcatgcatatctttaacttcagcagataagcagaaagcatttgacaaagtggttgagaaggtaatgagaattcctgttgctccacgttctaataaaaaacacttggattttctttcttttttttcaaatgacagggctctataatgggatcattgcatttctctgattactaatgagagtgagtactccttcatatgtttagtagatatttgaattgtatttgtttttgttgttgttgtagctcttcatgaaaagtactttctaaacagcatttctgagcaccctttagggagccaaaggccaaataagttagagtatttgtcacaacatggcaataagagaggcgaattcatccattaattgcttgccatatgcttatcactggaatatattttgcagcatctcctgacatcactatttatcccttttaccaaaaaaaaaaaaaaaaaaaagaaaaagaaaaaaaaaacatggctactgataatacttgggagcactcaacgaaggtcccgtctgagactctgtagaatatattatagaatgcaaatattctttggattccgtcttgttgttgttgttgctgtttcctaccctacaacttttggcatctctacccaacatttttataatacaggactgtctctgaggtttgttttccttatggttgttctcatgtataaaagagatgatgatagcgtttctcatgccagtatgtctgtgtatgatttatgttgtaaacagtgcaaagagctttacagccattgtctcactaatcttcagagcatcttttcgaaatagagaggagacaagtgaatcaacatcctctatatcacgggaggaaacatatctccctgtggagagatgtccactgctttatcgacaaggcacaaagctgcgaacagaattcaggttgtattctgactcctacactaatgcctatggactagacatggtgtaaaattttatatgcgtgaaacatgaggtgtattcatcaactgatcactattagcaactggctagaacatgaagtgtttgtttgtttttcaaaagaaagatatgatgaaactttatatgcttttacacagttctgatattttaacaatttgactaatttttatagttttattccttccagaaattcctttaactgtgcttatcccgtaagtaattgctaatgttcttaaactaatcgagaaaatcatttctattagtccctaaatacccagacttcataccttcttgcttcccactctcctcatatctaatctctcccttaggtttagcaacaaaatgtgcagcttgacgtggtcagtgggtgtctgaacatttagtgctagtgtttcctctcatctctctgcttttatttggacttctcaactcttaaaagtaattttaacatattataagaaatctttgaatttataacactttacagtttatgaaagactatataaaggttccttctcacaggctgtaaggggtacaaggacaatgaaactcagatgacatccttaaatgcactctactattatatggctaatttaagattaaaaatctggtttcataattattagtctagtggtccttttataggcagcataatacagttgtaaggagtacagactgcctgtttttgaatcactggtccatgctaactagctggcttaccttgggcaagttacttgaggttctctgtgcctcagtttccccagctatcaaatagatctaagagttgtgaaaattcaatgagttgatacatataaaaatacttaaagcagtgcctgtccaacataaatgcttaataaatgttagccctattatctttcctcattatttagtgttaaagagcaagaacatctataaaaataaaaatcaaataatccttcaaaaattcctgaatattataaaactaacatataatgtcaactaaaattgataccaattagtttccttatcttgaatgaaatcagtattgtagtcagagccaagctactgacctggattcacatataacattcagtttctcttctgaaactccagctcacttagcacatttatgccaaaaacaacaacaacaacaacaacaaaaatgtataaattgcctcatttgtttgaagtgtaacactcaggttttccatacagcaggaaactctgatagaagtatagattaataggcaaggcattgctccattccctaaaggcgtaataaggctattccacaaatatgtattgaacttctacacaggtttaagaattatgaggaggagagaagatattgtaatgaatccctactattctgtttattttttatttctttttaacttttaagttcaggggtacatgtacagatttgttacataggtaaacttgtgtcatggggtttgtagtacagattatttcatcacccacatattacacctaatacccattagttgattttcctgatcctctcactcctcccaccctccaccctctgataggtcacagtgtctgttgtttccctctatgtgtccatgagttgtcatcatttagctcccacttacaagtgagaacatgcagttcctgtgttagtttgctaaggatattggcctccagctccatcagtgttcctggaaaggacactatctcattcttttttatggcttcatagtattccatggtgtttatgtaccacatttgctttatcctgtctactactgttgggcatttaggttgattctatgtctttgctattgttaatgctgctgtaatgaacatacacatgcatgtgtctttataatagaatgatttatattcctttgggcatatacccagaaatgagattgctgggttgaatgctagttctgtttttaggtctttgaggaattgccacactgtcttccacaatggttgaactaatttacactcccatcaacagtgtataagtgttcctctgagtacctgttattcctttgaagaaaatacctacacaactagataattagagaaggagagaaagagaaagagagagaaggatggcacaataataaagtgttttttggaggcaaggatgatgttttatgaatttttgtattcccagaaaataacagataagtggttattagtgaatgaagaaatgaatgagttaactaattgtagcagaaaagggaaagataaatataaataaaggtcatccatctatttaacaaacatgtattgcatgcctaggaattgtacttggcttgaagactttaaagtagattaagacagtcccagacttcaaggaccagcaactgagggtgttaaacagaaaggacaatgacattacaacaagctgtgggttcacacataccatttcaagactagagaagagaagaaaatcagagattcttccagaaatgaaaattcttgagctggggctttgaggatgaggagaagttagttagttagaaaggaaagatgagtaaggttgggggtcaatagttcgagcaaatattgcagtatgaaaggtgtgagagagcctcaaacaggttacagattgtggcactataggtgatggggaaggagtgagagaggtaactacagagaagtaacctattaggaactgctaagaaatgttagatattatgctaaaaagcttggaatattttttaaagcatgggggcatcacttgatgatctttctcaaggacaggactattaatcttagggtttattatattcttcaattttgacacaatttatacttcaataattctctgtaagaatttttttcctttgtggtcttatttatttattgagatagggtcttgctctgtcacccaggctggagagcagtggcaatcatggctcattgcagccttgacctcccaggctcaaacgatcctcctgcctcagcctcccaagtagctgggactataagcacgcaccactgtgcctggctaatttttaaaaatttttgtagagacaaggtctccctatgttttcttggctggtctcgaactcctggtctcaagcaatcatcccacctcagcctcccaaagtgctgggatgacaggtgggagtcaccacatctggccttatttttttaacgtattttttaaaaacccaagaacaggcattttctgcgtaatgtgcctgcattttggctttgtatttactaatgcttgaattattgccttagctatacataatcaactgaagaaaagtatttaacttttagctacagtgatttctcatatggaaactgtatacttctcagggattgtggaaatgtccttggaagtctatgacccctcaaatttgagaaatgttgatgtggaggtagaattggagtaggcaggggaaagacaggtaccaggaaaaccagttcagagcctactacaataatcatatgagaaacaaagagggcttgaactaagggagttcagatgaaagaagaatctaatagttatttatagagtaaaatagacagaacttggtgacttccaggattttaggcttgagagagggaggactcaagaattgtacatgggtttctggtttcagtgattagatttctggcatctgctgtccataagatagtaaaaactgcagatagggtaaatgccagtattggaaatatgaagtttgaggtgtctgtgcacatccagatagaaatttatggaatgtggaagagcaatgtaagctggggttttcagcacaatggtaggtaggtattgtagttttgggggtgaaggtactcacacaggcaatgagtagactaaaaaaacaaaaatatagagaaagaagaatccaacaaagagattgagaagtagtggctgagaagtaggcagaaatttaggagagtggtgttctcaactccaaggtaggagagaattccaagattggaattgttagaaaaatttgatggagaaggtattctttgaactgtgtgtgaatagacaaagagctctgacagagcagaaaggaggaggtatggattctgggtgaggaaatgttataagcagtcccacaaagagtgacatcagatttatacaagaagccagagcttgactgtagtgggcagtacagcatagggtggaaagcatagactctgaaaccaactccttaggttcaaatctcagctctccacttttagctatgtgacccttggcaggttatgtaaccttctaaagcctcgattttctcctgtgtaaagtggaggcagtgatagtacattgttaatagattgtttactttttactcttctgtatagacggaccccttgcaaaagtcagggtgattttatatatacaacatcgttatcagctacctctgaatacttgattcttttccttctacaaccccaacctccatttgaaaagttctcattattctttttcttacctattctaaaagtatcactcagtccccacttcctccagggagcttttctgacgagtattcagctcttacttcttagacctccagtaacatctaatgtttgtcaagtacaattaagcacttgcttttacaaaactaattgtgggagattatttctaatggtttcatgttttttaatcttctatccccaagaaagattgtaaacttcttaaagtcaagatacatctccagggtatccgcacattttgccgtgcctgggacactcagtttatgcccattgtcctgatatagtttatatgaattcataatttatagtgtccacttttgactctctcaagagggtagttgtttgcatgataaattccatgaacaacctggatataataatacatactttttgaaattagtaacaaatatttattgagtggctatagcatatctattacaaaataataataagcaagggggagaaaacgaactgtcaataattatgccattgagagataatttttctgtctctgtgtgtgagagtgtgtatgtagagagagaaggagttttactaacaacaatgagattatactgaaggtaatattttataatctgcttttaaaatttcacagtatattgcatcatgaacacttttcttaccattaaatacaattctctatataacattttaatggcatttccttacatgaatatactacacttaagcaattttctattattaaatatttgaagctctccccagatttcacattataagcactattgtgatgaatatctttgtgtagagtctttatagcaaggctgggttgttttcttactatatatttctagaattagaattgtcaaactaaagaattgcccaatattttaaagatttatttttgctattattgtcatattgccctgcagaaagtttatatatacttcatcagcagtctctatttctacattatttccgttgctatattttatcattttaattgttctctttatttgatgaatcacatagtattttgttttaataagaattaatttagcttcaagaatattaaaatctgttttgtgtgtctaatggcaattatacatatttgctttttattattttattatttattcgtgggctgatttgttttttcttgttgattttatttttatttattttttaggagacaggtgtctcactttgttgcccaggctggtctcaaactcctggactcaagtgatctgactgcctctgcctctcgaagtgctgggattacaggtgtgagccaccacccctggcctcttattgattttagagtgttctttagagattaagaatattaacttttcatttatgtttgttttttacacttttttgccatttattcatttctatttttacttttacagatactctattttaataaatagaagtttaaatagtccctatgtagcctgtatgtttatattgtttatatagtctctatataaatatattttataaatccttagcaattcttttccaacaccaatattttcttctagtatttaatcattttacatcatatatttatatctctaataattatggaatttattttactttatttcagggctctgatgttcttttcctagattttctaaattgtcagaatcctaggtattacataatctattatttccttattggcttgaaatgccacttctactgtttatggttagttccttttttaatctttacatcctatttctagacaaaaagccccatgttataattattatggattttaagaaatacattttaatatctgggagaacatattccctcttaatcttattttttagaatttcctgggttattctcacatcgttgtgctaaattatacaaacaatctacttgtcaagtcccccccaaaaaaacccattaagattttgattgaaattgcattaagttgcttataagcagtttataagtactacagagctccttatgatatccctgccaactacttaagaaactcctagttcttaaattacaaatattcccagtcaagaaaggatcaccagacatttgaaaaaagacaaaaaaccaaaccaaacaaaaaaaccagtagcctaaacaaaaaggaactaataaataaacaggacaaatttattttcctgagacaatttatcttctgctttccagaagaaacagagacaatgaaaagtgtgggaaaaatttgtcaatattaaattttcagagatattcagggggagaatataaccattaagtatgatctgatttccataaatagcagaatactgaatatatatgtatatataaagattggataaaatgcaattcaagtaatattcattcttgaatattgaattaagcaaatatcttagaatatagagcaaaaagccaaggatataaaatatgatggaaaagtaaaaaagatatgaagaatgtggtagaagtggaggaatgggaaaggatgtgggaaaataacagaaaaaaaatccttgacctgaagagtaattcaagtcctcagattgaaaagtttcatccaacaccgaacaaggaaaaaaggatacatatctagatgtgtatacacatgctgatgaaaattttggaattctaagtataagaaattaatccttccagagaacaaaaaaaaaggatctttcaaaggtatcaaacttctcatcagcaagattagaagtgaatgcagactaggcaaggtttcaaagttctcaggaagaagaactagaacccaaaattgatagtcaaactatcaagtgttaagacaaactaaagatgtatttaaacatggaaggactcaagtttacaactttacctcctacagattcttcctaattaaaaggaagtattactcgaagatatattcaagcaaaacaaagcaacgggaatcctatacagaaaacctaggatacaaagagcattggaaccaacccagatgtttatgaaaataaatcccagtatgacaactgtgtagtagtaggcctagaaagcaggcagcctaagttagagtcatcagaaggttccaggaaaaatgctttcaagaagaaagtagacatcacatttcgaattgcataattaagagccttttaacattttagggcaaaagtaactgcatttaactcatagattaatctaagacttgatatctttataatattgactcttcccatgtaggaaactagatatattcttcaagtttttaaaaatgtccttcagtgatgttttgcaataatatttatacaagagttttacatttttcgttgtttatttatacatatttgatatgttttattactattatgaataggatcatttatctattttctaactggtatatagaaaaaaacctgttgtggatacatgctttataatgtttgacctttcttataaatcataatggtctaccttttttatacctttcagttgattctcctgaattttgagttacagaatttttatcttaaaatagaatgatttccttctctcttaaaaatatttgtacagcatatttggttttcttgtttggttgcttacgttagaattttctgagcaacattcagtaatagtggagacagcttctttttgtttctgatttcattgttaattatagatgtcgaagaaaagctattcattaccatgaaaaggaactattctattcttattgtactgagagtgctattttactatcaactctttaataagtgtgatatactactgtattaggccattctcatgctgctgtgaagaaataccctagactgggtaatttataaagaaaagaggtttaattgactcacagttctgcatggctggggagacctcaggaaacttataatcatggcagaatgcacctctttacagggcagcaggagagagtaagcaccagcagggaaaattccagaagcttatataaccatcagatcttgtgaaactcattcattatcatgagaacagcatgggggaaactgccctatgattcaattatcttcacccagtccctcccgcaacacatggggattatggggattacaattcaagatgagattttggttagggcatggccaaaccatataatctacattaaggacattgttaagtggcaggataaatggtgtgggctcaactttatactatagaggaccattatagcaatatcataaaagtaatactttgagagactaagccaataataggacaaatataaatttgaggaaaagatatacaaaaccatttagtaattcaagcatctagtgataattgtataaccatatggacaaaggtagagaaaaatacctatagaaagtttgaacttaagagataggtcaggtaacaaacccactttttttcttttttttttttacctgattacttcctggtcatgaggttcaaaatatttgatagcaaaatgatttaaagtccaaattaatattgaattgaatatacacattacagccaaaaccagacctatttttctgttgcttatcatatataattatagaaagcataactgaacaacaggaagttattacttcttaaatatcagaaaacatttgactttctcttctgaaataaggaacggcagtaaccgaattctagttactgctcttaatagttttgtagttctcataaaatattgcttatatattatttggctcccacactatccattttgatggttttaaatttttcaaataaaaataaatgagttttcatactatggatgacttgacatcagttaaaagtgtaaattcatacttgaagatagcaggactctatgctctttcctcattgttctggtcaaatacatttccaatcatgataatcaataatgtgactattaatttttacttgaagttaatctattcatgtttgattagaagtgtctaaaacataaacttgggatgtcaatgaagaactttttaaaattctcctccacaatggctgataatcaggccatgattatattttgaagattttacctagttagtcatatttggggtaagaatatatgctatctccttcatattaatagttcagatctttaattataacatgtttcatggtctataagattaaattgaacattaggaaagcttagcatttctcatttgtgagtcttacattcacacctgtcaggattggtacagattcaagcttgtttttaataaacttcaaagaagatcaaaactagggatcatctgtttcatgtctttgacgtgatagaagtttggggcccccgttttgccctgtagcttttgcctaaggagaaagccacccttttcagctgatacttgctcccacaggtttttcacagtttttgagtagcgagtggcaagaagcaatatgacgatgttggtaggtagagagatacttcttcaccatctggtgagcattctggagaacagagacaagtcccacactgttaaaggagtgaagtcattttgcagccagttttaaggattgatttaagaactctaggagcaggccattatgtagtcatccattcagcacgattcttcgtgggactgtttacactagaaggaactgtagtgatcaatttagcgttgaggaaactgagggctacagagtgccagggtcacgttcatcacacttatttgtgtttcaaagcagaatccacactccaaaatgtgcaactactgtcttactatggaatttacactgacacattctgaggtcatgcaggaaatagaccagagtaaagcattagcaattaggtcagtagcttgagataatgcaggctctgaggcaatcttcactttcactgaccacagactgggattgggaacatgggaaacgtgtgtgtgtacagacacagcaacccttttctatgtgtcatgtcttcagctgagttttaagttgtactagtggaagccatagcctatgttggctcataggtcctagtgccctttccccttcccttgcctctgcccctgcccctttccttgccttgcccctgcccctgcccattccccttctcctctcctctcctctcctctcctctcctctcccctcctctcccctcctttcctttcctttccttgacactgggtagagtgtaatgcaatcatagcttactgcagccttgaacttccagggctcaaccagtcctcctgcctcagcctctgggtagcaaggacaataggcacacaccattatgcccagcttattattattattattattattattaattttgtagagatgggtcctgctatgttgcccaggctggtctcaaactcctggcctcaagcaattctctggcctcagtcatgcaaagtgtagggattacaggcatgagccatctcttccagctctagtgctatctctttataggaatcaaaaatttgttttggctatttcaaattttgtagagtaagaggtcaattagaaaagactcagttatgttttcaaaaatgcactgtgtgcatatgtgtgtagaaatgtattagaatgaaataacatttttttacagtggctaccattggtttgtgaaattatgcatgctttttcttaattttctctaatttttctctatttcctaagatttctaccatgagatttttctcttaatgtctagttttattacataggtaatagataaatatattcatgtcataaaatatttttaaaattcagaatatgagaaagtcctttttcatgctccttagtcttgctgtctttcttgaaagtatccacttagtgatggatacaatatggtgtatatctgccttaatccattttgtgctgctctaacagaatacttgagactaggtaatttatcatgagctgaaatttattggctcacagttctggaggctgggaaatctaaaatcaaggtgctggcatctgttaagggtccttttgttgcatcaccacatggcagaaagcaaaagggagagagatagacagattgggagagagagaggaaaggggaccaaacgtctcactcttttataacaaacctgctccagtgataacaggattaacccttacatcagggcaaagctcacatgacctaacacctcttagaagtcccaactcttgctggatgtggtggctcacacctgtaatctcagcactttgggaggctgaggtgggtggatcacttgaggtaaggagttcgagaccaacctgcctgagcaacatgaagaaaccctatcaatacaaaaaaatacaacaaaatagctgggcatggtggcatgtgcctgtagttccagctactctggaagctgaggtgggagaatcacctgagcttgggaagctgaggccacagtgagctatgatcatgccactgcactctaacctgggtgttgaagtgagaccctgtcaccaaaaaaaaaaaaaaaagagtcctacctcttaatactgttacaatggcaattaaacttcagcctgagttttggatggaacaaacattcaaaccatagcagtatcttttcagaatttttaactgaatatttatatatatgaacatttagaattaggggtaatttttaaaaatcaaaagtgatatactacagatgttattctgtgattgatctttgcacttactatgttttggagattattttattttagtacgtataaatctataccagttttcttaaattgcagcatagtatgtatatcaagtttatcctttaactattttcttactgatggccttttttaatattgcaaaccatactacactaaacattgtcgtgcatacttccttgtgtattacattggtttttaaatcaatgaactagttgtaaacatggagagaaacaacaaggagggagatggatataagagaagaagagattaaaggggatggaatcagttgtttctggagcacagaatattcaccaaatttgaccagatgcgcggttgctcatttaggaaagagcaactgcactgggatgaagaggttttttaggaaatcagaggtcttcagagaagttttggttaaaatctgcagtatacactaccaaaatggtttttgtctttgttgttcttatgcaagaaagactagctctttttatctagagctggaaggttgctgtcttggagtgggggagaaaggagacaagtatctgatgggtgggaatggaaggtgtgtatccttgcagcagacctccagagtagctgactgactgatatgcatggtagtcctaagatgtgtttgagaaaagaaaatattaggagctcttgacaaatcttgaaaatcaatacaaaaattagccaggcgtggtggcgtgtgcctgcagtcccagctactcagggggctgatgcagagaatccctagaacctgagaggcagaggttgcagcgagatcgcaccactgcactccagtctgggcaacagagtgagactctgtctcaaaaaaaaaaaaaaaagaagaaaaaaaaaatcagttgcccatcctgcagatatacagtatagtgtaactgcttcagccgcttgcaaatctcttttacaattcaaaacaaattatggagaaataagagtgaaatattttcctggaaaaataatgtgaaaaattgaagttttaaatatcatagttaaattgaatgtaccttagggacaactcctttatttaaaactccaattctccaataacacacctaatatttgttattttgttgttaaatatttactctatgtagacattatgctaagagtataatgcctttttaatattcagaagagcactctaaaagctattacagctttacagacaagaaacttgagaccagagagaggttaagtaacttgaccaattgtcatatagcatttaagtggcagagttaggatttgaacccaagtttttatgtatttaaaattctggctattaacaccacactgcaaagaaacttatttagtagataacaagttatatccatatatttttagatatcaatatatatgttgtggatcggtagcttggggcacattactgctttgaattgtggtatcttttattagatattgaaatactggattattgataagaccatgtagcagtgagaaaaatagtttttgctttgatttgtgtcagttatactatgttgttggagcttttgaagtagggagtgatcaggtagagacaggcagaagagattagtttgtatgtgttatcctgaaatctgagttatttgacatttttaaggcaaggcattgattgagttttatgaagataaattggcaaagaaaagtaatcccatctgctcaataacaattctttgcttttagccaagaaaattgatttcaacttgagagtaataatcatatttatcacacttgttaattgcatgaactgtatacaaattgtcaggcttattaaggtagatatttacggtcactgggcgttcctcacattccacattttcattgttatggcattaactattttttctgtttctctctttgtcactgaagacttcacgtagtataatagccagtattttctgtgattatatagcaatattctcaaacctaattgttcatacaaagtacaaatcagggactttttctactaggttctgaagtacttgttctctagatttaaactccagtgttgtactaatgggagtaagtttttcttttatctgccaaggagctcctcttacatgtaaaaaactgttgtttttcctctttgtaaatatcagtgtaaagtacacactgtataaaatgtaaattactgatgtgagagtggccattttattcacattgttcaatgccaaagtgggccaaaggattctggctcattaactttaaggaaactatagtattcttttgtctctttagccttccttctggtttattcaaagaattctcatcaggttgatcaagagttgaaaagtaaagcactgttcttaaaaactgctctctagaaagatctgcaatggttttgaggactgccaagcaacaggaggtagaaaaatggataactaaataacctcatttacagaaaatatgttaggttaaattgcataggaaaagatagtatgggtctttaaaaaaaatggatatttataacaaagaaaggataaaattaataagtaagttataaggaatatttagaaaaataaaaacagtattctaaaagacaatacttatatctttctaatgtaaatcttagaaaatggtgagaatttcttgtatgctttatatttataagaagtaataatagcttttgaaataattccatattataagaagtcttttcttcatatgtacccaattccaaataagtggatgctggaagaaaatctgtaatttattttatttaaaagaaatgcagtatattaataaatacctattttttggataataaaataagcaacattttccagaatgaggtttttttttgcaacaaatgtgcataccaatgatttgaagtatttaaaagaaacttttctacttgaaaggaaccaagatgactaagtactaattttgcggaatctccaattgggaggatatctactgctcagaaaagcaaactaaaacaagacaagaaattaaaattgacaaaggagaagttccatataatctaattcaaaatcaaatgagtttttcaaagaaataagtttcatcatgtaatctaagccaaaatgagctgaaaatttacacacaatttcttttctttttctttttctctatttcccattaggtggtttccatccatggaaactagttacatggcattcctaccatcccatgcccatggtagacataattaagaaattgtgtgtgtgtgtgtgtgtgtgtgtgtgtgtgtgtgtgtgtgtgtgtgttttgtaagctttttactccttctcaacaaagcatttcaaggagccaacagcaaattagaattgaaactccattatgtctctcaggtcttctgatcagctcttattatacttactcttagtaaaataatctctattaatagtgagaagtaaggaactatatgatataataaaaagtgctctaaaggaagtcagaacattgtgtggaagtcctggttccaccattaatggtaaactctttgaggacttccaatttctccaggactggttttcaatctgtataattaaggggtttaggctagactctctttttattttttgaaacagtgtctcactctgtcacccaggctggaatgaagtggtacgatcttggctcactacaacctctgcctccctaggttgaagcaatccttccacctcagccacctaagtagctgggattacaggcatgcaccaccacgcctagttatgttttcgtattttagtagagatgaggtttcaccatgttggccaggctggtctggaactcctggcctcaagcaatctgcctgcctcggcctcccaaagtgctaggattacaggtgtgagccaccacacctggcctagacgctttctaaaattcttttcagtttcaaccttctatggcttttggattcttttatttcttatactttcatattactgaatctcataactcactttttcctccattttatattttcaacttttctagtctagggctctgcacaagttattactctgcccttttattactactccaaggtaattcatgttatatgtagatgtatattagccatgacaataaatctacatactgtattatcatctttccagaatttttcaaaacagaaagtctttcttgactaatcatttattccccatataatagtatgaagttattaacaaacgttccttgaattatgtgtgacagaatttgctgggagcttgaatcagtatatttgtttaggctgcatataacagaaggcttcatttaaaatagcttaaataataagagatttattgaattatataataagaaggtagtgatagaatgattctagtagtacaaacatgcatcaagaatccagattctttccttctttctagtcacccatcctcagcacagtagtttttgatctcagttttatcctcttatggtctcaagatgactacagcagctctaagtatatttatacaacttccttttcttctgtcactttttaagaaagataaaaactttaccagaagttccttaacagatttctttctcagatctgtattagaaacaaattcatcatatgcttatatctaagccattcattggcaagagaaatgctatgaaattggctgggaagtaatcatggttcatcctggtcctgggaggggcctgatctcccttgaagcaccaaccgcctgacacctgaacaaattctagtggctgctgggtagggaacaacagtgtctttacaagttggtgcattataaatacatttccataatttgaatcaagcctaccatctcctcctcatctccaaccacccgccccccccgccccccactttattttctgtatcttcagcaacttccagaaacttctcattcttccttaaatacacatttttgtacctgccatattttgcatgccctcttttatcagcctggaatgcactttgtcacctttgcagcctggtaaaaccatcattgtgctcatatttcaagaaccacctcaaatgtctgctctttagatctgaacccttcctgaattccccagcttagcaggtcaagtgagttgttctcagctttgtacttctgctatagatcagccctcatcattttataactatgtattgacccatttactcctgagaatcctgtaaggatgggactcagttccttggtattttgttctcagagagatgatgcttcatacttaccaactgttcaataaagtttgttgaattaatatagttaaaagcagatacctttctgttataagttcaaagcctagtgattgaagatttttctttacattatttaaatgtatttattttggtaaaatatttagagcaagtttcattccatctgttccatctaagcgattcatgacctgcatacattctaaatgacaggaaccacaagcaactcagtcagcaggcttcagaatcggtcatcctaaaagatattgcaggtcaatggctaatacactaacaaagaaagagcttatgcaaataagtaaggaaaatactgtttcaatgttaaatcattaaagacaaattcagactactcacaaagaagatctataaatgccaagttagaatagtaaaacagaaaacaaaaaaacaacatgaagacctctgattacatctatagtaattaacatatccatttaactcctctgccttcagaaaaccatcaatggatgtttataggcataaatgacaaggacaaagaaagtgggaagggagataacagcaacaaaattttggaagctgaaaaacaagtatacaaggggtatacttcctgatgaatgtaaaaccgtccctagacaaggggggcctaggcaggttgaagactgagtgccattctgaaaacagagggattaaataaacacttatatatttgtgttcatgataacacaaggctttttaaattctgtttaccactgtgtctccggtggctagaatagaggctgccaaatatagatgctcaaatatttgttgaatgaattccgaaggttgaaagtcccaaccttcttcccctagtcagcttccaactatgcttaagccttctggacaggagattgatataacctttggagaattcaccaacccaagagaaaaaacccaaagataatggtgcaaggtatttctgaatgaaactgttcagttggatcatcaaaaagtggatgtagttgacaaatcttacctatgcaaacagagcttccaatctgatttttagtactctagccttaaatatgagtagacagataagatttatcaaatacttagaaaaagtaagtgaaagaaaccaaaacaaatggaaaaagaccaacttcaaagtacagatgttggccgggcgcggtggctcacgcctgtaatcccaacacttcgggaggccaaggcggggggattaccttaggtcaggagttcgagaccagcctggccaatatggtgaaaccccgtctctactaaaaatataaaaaaattagctgggcgtggtagtaggcaactgtaatcccagctactcaggaggctgaggcaggagaattgcttgaacccaggagatggaggttgcagtgagccaacatggtcccactgcactccagcctgggtgacagagtgagactccatctcaaaaaaaaaaaaaaaaaaaaagaagagaaataaaaaagtacagatgttgcaggaagaaggtatcatcagagagaggagaagaaatacacttgatattgtattcataaatattaacattgcttccacgaaacaaaagcagatgctatggaaaaaaaaaaaacaactcagagaataggaaaagagctcttggaaagtaaaaacatgatagaataagttaaaaactcaatagaagggttgaaaggtaaattgaggacatctctatggaaatggagcaaaaatacaaaaaggtagaaaatacagaagaaaaagtgggaaatcagaggaccagttcaggaaatctaacatctaaaatcagaaattctagaaaaaagagaaaactgcaggaggacaaaattgaagaaaaatttccagaactcattaattggagcatttagcacaatataaagtattaaaaaagagacttgtgacttgttctaaggatcattatcgtatcgtatagaaggatcaaaaatcaaaagggcatcagacttctgaagattcgttttgaaacctagaaaagaatgaagtgatgccttttaaattccgaaggaaagtgattctcaaccaagaattctatactcaaccaaactattgatcaagagtgagcatggaataaagattatttctgaggtgcgagcctttaaaaaatgtatctctgatgcatactgactcaggaagctactggaaaacgtgctcaccaaaacaagggaataaactctaaaaacattacccttgggataataaggaaagaacatcccaaagtgacagctgagcaagagacatggagaataaccaatccaggtcaaagaggcctctggatgagatttcttcaagaagatgaatttaataaaattcttgatgtgtttgagccatacttagatttttgtaatatgggaaaagtttgggattgaattagtgataagtatatatggacatctaagggaacaaagaaactaacaaaagacaagaattttcaagaaggaaaacaaagaaaaaaaggtaatcagggtatgttacatagtttagctgcttatagtttttctttggttctgctcatggaaacacaatgactatcaatctaagtaagactataatatattagaaggatgggtgatgagaagtgtgaagtgttgcaaaggtaaatccttatcttccgctatgaagtatcaataagcaatgcccaaaaaaatgaactattaagaagtaactgtaaagttatatcatttagagatagagtggagtatagcaaatgaatcagctaaaatatttgaaaatgggtaccctctggggagtggaagatacatgtatgtattgtgggtgggggatgcactgcaggagatctctttttttaatccttgtggtactacttagttctctaaactatttgcatctataactttgctaaaaataacatttaaatttaaaaattgatcactcttgtaataagttcaaattgaaacaaggagataacatagttgctaagttttatttttggacatatttataacattgtatatgtgttagtgagaataccatgtaacatcactctcaagcagtacttctaaaagtagaaattgctgtaatatttctcaaaaactatctggcaatacacattaagaggtataaaaatgtttattccttctgacttagtacttctgcttcagaaatctcttacagtgatctaccttctagaaagactggagataaatacatcaaaatgttcacagtagttgtctctgagtggtagaattatgggtaaaaaaaagatggcttgtttccatttttcttttgcacccctctgcattttttccaaataatctataatgaagacaggctccttttatatttggaaataatttccaaatataaacattttaattttataacattttaaatttttcaaaacactggtcctcataacaagaaaagttatttgttgcaaccacagtagaccaggttaatggtgccaagagtggaatgcggataaaggctgacaaggccatctggaactgtgagtcattcagagcatcacagaagagagattttctgcaagtactagctgtgttgactgtgactgctgttttcctggttgctcaggaatcacccagggaaggagagggcttccccacgggattagggaaaaaaaaaaaaaagcttcttgttccataagagagtctacagataggatgagtaataagggatagattttactaaggtagaacaaaatgttaggacgctggtacgagcaccactgaaatatccctatatcaagttttagtcttttcattgcatcttctgaacctgctggagatgctttcacatggaacgtatttgctataaacttttctttatcttttgttcaatgctgtgaagtttgctaatcttaatgaaccaagtctcttcatgctgacaactcattgtaaaagaggtaaaactgtgtttccatggtatggggaatggagaggtataaggaggaagatggatttaaattgatttttggaatgcttgctttattttatcagttaaagaaaaggtctaacggattatttagataactttaggctccaactgcactgatctgtttgtcattcctttaagaaaccattttgattctgactacttgaatttgcacattttgttccttctctctggaataccctaacaaattctttctgcctgataaactacttactcttccaggtcaagttgaaatgttcccttcagtgtgaaaactttcatgactcaaaaaataacaattataataattacaatttgatgagctacctggctgtttacctaattctcacaccattagatgagcgaggtagttttaggctaactttaaaaaggaggaaactgagacttacaagacttgggtatgtggcccaagagtacatagctagatttgaaacccaagtccaaacccaggacttcctgcttaaagccccttctttttcaaaaactacattacctattgattattttgctttacatgtgcttacatgttgatcttcctcagtggactgccttcattccttaataggaaataaattgtcttttttggaggtgttacatttttgcatataacattaataagattaaaattttcatttgttgttgacattctttgcttgactctacactccacgggataggatccttgggcatagaaaccacgaatgctttgctcatcactgaatccagcatctgtcagtgtctgccatataggaattgctcaatatacatttttgagtaaataactgaactaacaaatgagtgaacaaaagaacaaatgaataaaaaacctcagatctagcccctaacaaaaaatacttaaaaaaaagttttagtgtctcaattgtctgtatagacaatgatttcacaagttcacgtgaaatacactaccaatatcaacaatcatgttaaatcaaatgaaatctatatcctctgggaatgcttgtggtatggcttagggacaagctttacttatgaacaatgatactgagacttcacaatagtcagctgtgcagatgtcagactttgcatttcacacatgcttttaacctagagctcaaataggcagttttaagccctggacctcaagtcaatgtggttcatgttttgtcacttcaagatctacaattgaacttcattacgatagtcttagatggtttttcataaattttgagtcatgaaaaactgacaacatatgagtctccaagtaccttttaatatatgcaatattttacctacttaattaatacatgtgtttatttgataactaaaaagtttataaagtctagaaataaagaaaagtccatgtcctttttcttttttgttttcttttaaatgaaaactcatgagaaataagagggcagaatgcattaaattatttcttctgtaacagcacaattctatatcagattttaaatacaaaagaacatgcaaagggataacagcattgacttcagttctaatataaataaggcaggaaattgggtgaaatcagtttttcctctaatcttacatggaaaaaaatttgtcatttggcaaacccatatgaatccgatctgtttggtttattcatccatgcagtgacattcagactccaaaaactgtatcagaaacctagtcaatatttaaatgccatcatatagattagaaatggaataaggtataggtaacttactgcatttcaaaaaaagtactaattgaaacatattgtcaaacatatatctttttctctctttagaaacctatggctattttctgtctttcagctcacgctacagaaaggcctatttttccttctgtcttagtccattcaagctgctgtaacaaaatatcatagccaggcacagtggctcatgcctgtaatcccagcactttgggaggccgaggtgggcagatcacttgaagtcaggagtttcagaccagcctgggcaacatgatgaaacctaatctctactaaaaatacaaaaaaatcagccaaatgtggtcacaagcacctgtaatcccagcaactcaggaggctaaggcactagaatcacttgcacctgggaaggagagggtgcagtgatctgagatcatggcactgaaatccagcccgagtgacagagcaaaactctctctctaaataaataaataaataaataaataaataaataaataaataaatcacgagctgggtggcttataaacaacataaatttatttctcacagttctggagactagaatgtccaaggtcaaggcacggtagacttggtattttgtgagggctcatttcctgggtcatagatagtgcctctggctttgtcctcacatggtggaaggggcaaggcagctctcttgggcctcctttataagccactaatccccttataagggctgtgctctcatgacctaattatctcccaaaggccccacctcctaataccatcacattggtgatgaggtttcatcgcatatgaatgtggggagggacacaaacattcagactatagtatctgctttttgccacagaatgaagaataaaccacgtcttataaataaaaatctttccatggtcccccaccacataaggacatgaccaacttcctttgctagtcatccatctctcataatcctctccagcccatctctgcagcctcatctccacccacacatgcattctgctgtaacaaatggtgggcaggcttccaaatgtactgtgttcccatgaagttgcacctttgctgatgttattctctttgcctgggtcccctccccatctattcactcctttctgcacttcacccttgctcttcttgtgccctaatagctcctccttttgtgacacatcaaaaattgcccactgtaggaagcccctccaagactaagagtgcctctctctgtgttcctgcatgtgcttttggagcccttatcacacagttgctctagaattgttagcttgaccacactgtgagttttcttaagggcagggacttattcctctttgcatatctggaatcttacccagtgtttagtacatactacatgttcaataaatatttgttcaatgaatcaatgaattgataggttttcttttagtagaaggaataaggtacattttttttagaacagcatccgaaaagcaagcaggaaaaattgggacatctttgcttaaggtaaaaatgcttttatggggaccacctttgaaactccatctacttggatccttttagtcttctttatgagataggaatattaattcttagatccaattaaagaaggtctagttaccaaggaacaaaacaaattggtatagaatggactttcttataagagagtcccaaatcatagatcataaggacaatcttatgttgaaatgtctcaataacttccaaatgccgatgtgaatgatatcatcaaacagtgtgagtcaaaggaagaaatgggattcctaagttttcattgtactccttgactattttattggtgtacagtctcttgacaattattttctcatcttctttcccaaggaaactttagatttaatatgtttattctgcaagatgtttggagacaggtatacaccctaaaaccaccattacaatcaatgccataaacttattcattgcctccaaaagtttcctcccatctttttgggtttttttgttttgttttcctttcatggtaaggacacttaatataacagctacccttttaccaaatttctaagtatacaatatagtattgttgattgtatacttatgttatacagcagctttccagaacttattttgcaagactaaaactttgtaacccttgaccacatctaccaattcccatcttcccccagcctctggcaactaccattctactttctgcttccatcagtttgactattttggattatacatgtaagtgagatcatgcagtatttgtccttctgtgtctggtttattccacttagcatgatgtcctccagttccatccaacttgttgtaaatgacaggatttccttccttttttagggctgaataatatttcattgtatatgtgtgtgtgtgtgtgtgtgtgtgtgtgtgtgtgtgtgtgtgtgtgtgtgtgtgtgtatatatatatcacatttcctttgtccattcatctgttgatggacatttaggttgcctctgtatcttagctattacaaatatgctgcagtgaaaatatctctttaagatccagatttcagttcttttggatatataccaagaagtgggactgctggatcaagttacttcctgtttcgaaagtagggcaccctctggacatttctacaactgaagtgattgattcttacttttggaagtcaggctatttgttggaatggtggggaaaaaagctagagcttaaaaataaatctaaagttggagaggggattattactgatggatgcattaattcaagggttactgatactctaaatacatttttaaaagttgtttgattaacaagtcaaaacagatggtttaatgacattttagagaggtttaatagagatccaactgaattaacaaatcaccatggtgtgcagaatattgaaaattcaccactagtagatttatggcatatttctgggtatttcattcccatttggtttattatgataaatcactgggaaacgggtagcctgtaggacatgacagcaaaccacactttggcaggaccagcatcagggctgcgtgcttttttaggaggctatgtagtctagctagcacagagtgacccagtgagagcttggttggctaggactttctggtggtagcccacagagctcacctgaaagagtaccaaggatgaaaatatcatcttggctaattggtctgctagttgatttaaaaaataaacaataaaaaaaatttccagtgtattttagcaaagtttaatattttgaagggggcagaaatgtagcatattttgggatcttaaatctgaatttgtgtctttttccagactttgtcagtgtctttgtctctctctccctctgccccctccatgtctccctccttccctccctccttctctctttcctttcctggtaagtatactagaaaaaagtatatttttttctcattttttttaacttaataacaacagcaacaatgacaacagtcaaactcttgaattctggtcacaatccagatcaataattttttccttgtagttaccttggaattaggttcttagcccctcactgctctctgtatatttctgtacaatattcatcagtttaaataagtacttcaatttcataccaaagtgccaagactatcctattttcactcatctttaactttcttctttttcatttcccacacccctgccattgccaaacaaaactgattatctctgtttttatctttcttttagactttttaaggcaataaaaaattggcttgctcagaaggctgatacactgagtgttagaataacccaaaggttagaatgctttggtcaacttatgggtatttttgatcacgtatatccatttttaaacctgccattcatgatggatcactgaccctggccctggccctgacccatctcaaaaagttactagcatgattactgattaacacttagactgttggcttgaagtttagtagcctgaaggaaaatttccagaggcattataataaggaagtttaattaagagttaatgttgactcaggaatattatgtatagcattgatccacagtgttgctaatgaattcattatgctgcaaatgcaagtgatttgttagtacattggccaataaaagtgaaatctgtctcaacaagaatgttgaaagaaagaaggcagtgaaactttcatctccactgggagtgaactaacttgccaaatctgggtcatcaatcatagtaaaatgttcaaaacaaataatgcatctttcatggttcactgtattcatcagcacttttgaagtcaccagtctagagtagtcgcctttggccaagttttcagtagcctgtggtttaggcaataagcctcaactgtctttctcgaggatatgttcccaggtggttgtactccatgggccattttcaatcaaatctgaaaggacaaaagggcagttctgtttatatgaaatgacatcatattataacctcaaaattgttgtcttaaaagtcaaatcattatctaaaaggtctcttagaattacttagagcttgaatgcaaaagactgaatttcccactcacgtacttcgccaacactcattacataggcaaaaaagtatagtaagtgtcacttatgtgagcctatgtatgtatgtagtgttatagggggtgggggtggcaggaaagacagctcaaatatgaaataattgaattattcattgccactgttctgattgcctttaaaaaaagttttatctggaagttatttcagacacactggaaagcttcatgggtagtgcaaaaaaaaaaaaaaaaccacatgcattcactcattgtaaacattccacctcatttgcagtatcactctatgtgcacatacacacaaatatacatacacacacattgtctttttttctctgaaccacctgagagaaaactgcacacatcatagccctctatccctaaactcctcgatgtattcctcccaagaacaaggacacttttctgtataactatagtctcaaacatctgattgcctttgaattttatagcatgacttatttatacctttttacttcgagttctaactcagatactgagctatagaggaacagctcaactattagttgagggatagctcagatgtctgatggaaaaaagtcacatcagtaacattttgaattctgcaaatatacacaatatgccaatgtatgggagataactaaatactggttttagagaaaatagatgagttaatacaaatagagattccccttaattaatagatcttatatgtttggttatatgtcttatccatgctattatagctagctagcattcattaggacagccagagaatcttgtctttctgtatttttatactgtttttcttcttctgatcagccgattccaggttttgaaagaatgaagtagttcctacttagataatgctattgccttgctccttaacagtaagcagtggagaagcagagtggacgctggtgatgctgcctttagtcctggagggagtgtcaaccagtgggtaatcattctgaccctgcaacacaaccatcccttcactatttcagtgaaggtctctacttcggtggtaggtctctactcaacatggtacttatagccgttttatacttgctatcttaaaaaaatatgcaggctttcactgctgtgaacagataattgatatttatgtttcataatctgtgaagatagctaacacatttctgacagttgcaattttttttcccaaaacgagtttgagcatgcctatccctctctacccaagtatatttaacagcatttctatctattggggaatctgagtgaggatgacaacgtgtcagggattagaatggacaggaagagtctctgtaagaggagggtgtgatgctggagcaatttatgaaaattgggtcccctggtaactgtagtggatgttatacagacagtcctgcagagtcatccacgaggctgactcactgacaatgtacacatagaggtgggcctcgagtgtgtgcaaataacaagtttactactgcaggcaaactcttcgtttattcatttgacagatttatattgaggggcactgttctaggagctggggatttggtaataaataagatagtcatggtccgtaacctcatagagcttacacataaactgttttgctttaaaatattgtacattcagaggtgtttgtgctccgaccatatgactgcaatatgtcatttgataaacctttcaggcatgacttggacccacccagaacttagctttaaagctatcagattgacaggaggagagaacactggctttagatgacaaatcatggaaataattatgaaaagaccatccagtttttaatgactttacaagaatagtgttcttgtgagactattgaataagaagaaatatatgaacatttgtatcattcaactgtctaactgataccaacaccaataaatatatgaacatccttattattcaagtgtctaatgagtgagggacagtgcctgtaggaaggagagcctcccaacaatggaagcagtgttattcttcatggtagggagaccattttttggttcctcacaatgacttccaggctggaatgatttccaagtagggcagggaagacaaatatctgaagcctaagggaagctccagggtgattcttgtagttttgtttggcagactttctaaaaagcattgtcagatagttttggagcaagcagtttagccatctactaccacacaatatattcaaatcagagtaagctggaagaaagtcatccaacatccaagtctcagcctggcctatgtgaacatacttcttcttaagactaagctgtaggggtactatgcttattacctcggtgtgaaataatctgtacaccagcaccccatgacatgcaatttacctatatgactaacctgcacatatacccctgaacgtaaaatttaaaaaatttttatagatatgttaaatttgagatgtttattgaacatcaaagcaaaaatggtgaatgaacagatatatgacacaaaaaagactaaggtataatcctatatcatgagtgaataggaattttttgttattggtgtttgcgttagttgagattttattcagcagtaaatagagagatttaaaatagaagtggcttaaggaagacagatatttctccttcatgtaaaatctgaaagttggcagtccgaggttaatatggcacctctatccagtacagtcttcaaggacacgtgctctttccatcttattgcactgtgaggtgtagcctctgttgctaaattcaactcaccatccaatatggctgctccgactccagccatcaacttcacattctagccagtaggaaagagaaaacaataaatacaggcagataaaaagatagatgacaaatttctcttaagggaagtttctagcacatcatataatatctacataacgcttctactaccaactcattcaccaaaacttagttatatggcaacacctggcaaccaaggaggctgtgaattttctctattttgggcagtcacatgcttacatgaaaacaggtatttgaaaacaagtgatgaagaaaagcatcaatattaggggacatttagcagtctctgccacaatgttgcctattaataatcctgcatacattttaaatatttaatatcagtctgcaacactctatttgcaaggtaatgtatagtataatctttaccatatgaacttagtagccatggtgttcaggaaagttgtgttattttgtgctagaatattttacctgccctaggtaagggcctaaagataaaatgtgctagactaattaattttaatggcatatagcaagagatttccagcgttaaagattgcatctccacctgcaatttgggaaaggaaaaactgatagcacaaaataaaagtagtgggtgtcctgaaaactgtctgatgctcttcatgttcttaccaactcatatcctcatctaaatttgaatcacaggtacattctgaccttgtcgtagagagagtcctaaagtctcacgagagaattaccgtgcttgttctaacaagactgtgttccagcaggcatgccaaaatttgatagctacaaatagggagatttgaaaggaaagaggtgggagaggtaatttcttttaactcaactgcatctggtggattaaggtagacaatattaccattttgctgacagaaggcagacatggcactaaagagggagaatgagcaaccacagagctgatttaatttccagtggggtttatggaagcaccaaaacatgatgtagccaaatgttcctaaaagtatgaagtaatttaatttgttccatcattacaagaaattaaagccaagcacaattacatcccagtagtaaaaggaacccgctgaattgccattgttattgactaaatgaagtgagatttctgattaccttgtccagcacattttaatttctgtctgtccatttattccaaatcacattacagggccttaactgatcttgacaaaataagctacattattaaggtgcagtttaacctgagaagctttaattactagattagagttttcaaatgggcatgtcttctagacttcagtacatttagggatgtaattattagagattctttgtttctgatgtgcaaaagagacccaagtttaaaaggaagacttaaacttacggaagtgatttttttttttcttccaccaagagtctctttgtagacaggtgtctgttctgttgggagtggacttacacctcctgaatgctgtgattgagagagctgcctccatagtggaaagcccccggtagagggtagtacccagatttccaaggggaggggagttgggggactaaacgatgtacagtgaaccctctcataagtagggtgtctagatgatttagcattcaaaccagaacactttttagaatgaaaggcaatgctattcataattacactggtataacaggcatagaccttggaagttccaggccaattaggatgtatggactctgtacctataaggaagacaaggcaatagatatgtaaacaaatcaatgtgatagtcattataggcatctggagaatgaaaggctctataggacactgtgggtgggtgggcatggagaacagtcactctcttagggatttctctcccctggaacaaaagttacactaatcatgtgacatctcagagcatgaagtttgtagctccctcaaccatattcatattcctctaacagtccagttaatgattctcagatgcattagaaactatggaaatattatagaaaagaagccttaacaggggaagtgtttcatgctttttcagttccattcaacaaacatttattggatacctagtatatgacagccagtgtttagcaccagagatcaaaaaatgaattcattatggttccagccccagagaaattcagtctagtaataaacacataattgtgatagactgtttagtgatttaataacttaaagagttaacttctgatttggttctcatgcatcaaacataatatttgccagtctctatctctacaaggagccctggatttttcccagtcccctactaatgctagataatatggcaaaatacacaggctgatcaggctgttttagagactcttttaagcagagatcttttgttttccagactgctaatttatttttttctacccagaaagcccttcctaccatctgagctattctgaccaaatcagcgaagacaagctacagagatttaggatgtctgggctaaaaaggtttgcttgtttaattagataaataatttgagaatgctttccaggattactgttcctaaccacattgataaatgctgggaagactatctcagttatccagcattggataacagactgttggagaagagtgaagcttcagtgtgagctgggaaagatcccaaaaatcctaacatgctctaggtgcctgcatataaaattcatcatcatagtgactttaggaccacttgctatttttcaggcactgctttacatacatagtcctatttaaataattttcagaatcatactgtgatataggtactgctttctccattttataaattagaaaacaagctaggttaattcacttttataaggtgccaagctagtcaatcagtggcaaagctcagatttggaaacaaggactgccttactccaaaaactgttctcttaaatttcagtgtttgtaaggtccctcactgccccagcataacccagcatttggtccattcaaggattaagaggaacagggatctgccagccttgtttctgcagaaaaaaatgggggaggcagagctggatctaaccaaacaggttaaatttaagtgccaggtttccgtgaaggagaattatgccagcaatggtttctcaccttaatgaattcatttctaaccattctttgccctgcaaagacagcaggatcctgggtccacagggcccagttcatggagaggagaaagaggcacataatgggagcaaaaagtgaagaattcaagctgcaaaatgtaacggaattctcaaagtgctgggttctcttcactcccttatctggcagctcctgttttttctcctttgcctcccacagttgccactttaaaaagtcatttttaatgtggcacatatacaccatggagtactatgcagccataaaaaagaatgagtttatgtcctttgcagggacgtgaatgaagctggaagccatcattctcagcaaactaacacaggaacagaaaacgaaacactgcatgttctcactcataagtgggagttgaacaatgagaacacatggacacagggaggggaacatcacacactggggcctggtgggggttgggggagcaaggggaggaagaacattagtacaaataccgaatgcatgcgggtcttaaaacctagtttgggctgatgggtgcagtaaaccaccatagcacatgtatacctatgtaataaacctgcacgttctgcacatgtatcccagaacttaaagtaaaaaaaaacacaagaaaacaaacaaacaaaaaaactcctttttaaacattgtctcagcgtccagtcggttgagtttctgcacttttagacactcaagccccttctttcgtcctttgctccagtggttgtagcttcctacctccttcttaccctcacccctaggcttccactttagagaatttggagaactggggaaagaaaagactgttttgtgcatggtgtgcctgcagcctagtgccatgagctggttcttgccgtgtctgagccaccagatccactccttctgtggttcacacgctattccctctatcccagccaagcttgcaaactctgatcatgaactaccaggtggaggcggggcatggatatcctccccaggaagcctgtctggaacctctgaacttttctgacctgtgcatgcctctaccacagcacaccttaatttcttttgaaatcactgcatttgttcatttgttagttgtttgcttctagatggtagacgccttgaggccagaattcttctgaactaagctttggaagttgagcacctcatagaataccaagcttctcgtattactggtggggttcaacaagtatttgttgagaagtgatgaatcaagctaaagtttaagtaggcaaagatgaatcacgtcataacctctggtttcccaactttgtctatagaaaaggctccttgctaggtaaaacaaaaacagaagaagtatgtggattctcttcaactttgggactcatcaccctgaatctctcagttatctcaagactgattccctccaccctggagggcctccctgcccctcctttgtacagcagtgaaaggcagaaattgaatagaaggagggaaagagggaaaaaggtctagatgatcaagtggcaaaaacaaataacccagcatgaacaagtatgcagagagggaactctgaggaaacttgctgacaaaagatagagatggaggtgaggtcaaccacaggggaataatgggggcagacaagtctaaggaggtagattttatagggacttcgaatagatgaactgaagtttggggaagacctaaaggcattaaaaatccagtataagttcttgattaaggacagatatcataataattattattataatacaaggggtgctttgggaacataggctatgtaggagggattgacagaggaagggaggaaagatctaggaaaatgagggccaaacggaaaggtgtccttctcctgttcatttgccaatgaaatgcctaggatatatggtggtctgctcctaccctccacagttctagccactgcaaccaggatgcccagcaaccatgtcattcattcattcatatggtctatctgtctcctataggcatttcagtgagtggccgctgctttatgtgttctgttggtaaacttgtagtaccctgagaaaactcacacattatggagaaattacttcaaaaaatatgcacagtagttaactgaaatctttttatgtgttctactctcacgtgaagtagagaagtagagggagagttttttaattataaaaagggaggaagagggaagagggaaacaaaactaacatttattaagcaaggtaatttcttacctcagtgttttcaaaccaattggtagatttcaaaatcaatttaaggggtcacaattaatactttaaaattaaataaaatagaaaacatcagagtgaatcatacatagtaaggataaatgttatttcatgttaaattatgtttcaattctctgtattggctcgaatatatatttactcttatgtgtatggtatatactgttcctatatatacatttcctttttattttatatatataattctttttattggtttaatttatactgaaatgcatggtttgttaaagactgtaaacaaattttgccatgactattatttataaaacacaagagtttctttaaataggagtccactgctctcctctaccttttaaaaataaatataggtataaaacctttttgtacattttttttatattactgaaagccagcatccacatgccttcaaaagtgagcacctcttactttaaacaaatctaccaggttatagtataaaatataaattttactgtagtttactgtcaataaactttgtaagccactgcttcatttcatttaaacttccccaaaaccttgtatgagtggagtctggggattcagaagaagacggtggtcatcacagaagttgaaattctctactgtttacttcttttcaaaggtcttgttagcggtggccttgaaggtgatgaagaaagacactttcaaggtggacaggtataattattgggtcaccaagaacaaatttgaaaaacaaaatatgccaattgaaattagcatgtagcacctaaatacccagaagcttcttcattgaataatttattcattgaataaattatgtaaactgaattagtaattcctagtgaaatagtggatgaattgagaatagtggtattggtaaaaatggaaaaaaatttttttcttttgagacagaatctcactctgtccctgaggctggagtgcagtggcacgatctgagctcactgcaacctctgcctcccaggttcaagtgagtcttgtgcctcgcttgaggcacaagattagatttagtagagatggggttttgctttgatggccaggctggtctcaaattcctggcctcaagtcatctgcccacctcgacttcccaaagtgctgggattacaggcatgagcgaccgtgcctggccaaaaaaaaaaaacaacaacaaaaaaaaacaaaaaacaaaacaacttaattcataaaacttaattcaacaatttaagagttatacttcaagaatgaagatatataatgaaaatatgaagtcttcagaaggacacacatataataattttagtaaatctcaaatttgtctcaaatcaaaaacttgctacacatatttttgtcttaattatcataattaaaaatgtctacacattacataatactatctagtaaatatgccctagagattgtgtgtgtgtgtgtgtgtgtgtgtgtgtgtgtgtgtgtgtgtgtatgtacacccattatgttttcagacaattggaagaaaattgttaggcaattgtttttcttttatcaaggagctgtcatttaagtgcaaagctggagtattcaaaataaaatttgggcttacaagatcagggcatggcaagacctatccagattgctgtggaataatatatgcttccaaacgctaatcttaaggatgaaaaacacataaatgacatgccttcttccccttgcttaccttagtgactacagtttaaataatctaaaatagcagataccatcaatactgttgctaattatgctacttttcagagaggtacaagagtccttgtacctctagtagtagtgataccactactagtatcaaaaatacaagattgttttgttaattttgaccatgttttaaaaaaagatagggaggagatgaattactattaaaagcagctcttatattttacatgtaatagatgataattacaagtttttaacaaataacacatttaagttgaactgaaccgccaaaaaagatagagatatgaatatatgatttttagattaaagttagttttaacattcaaataaagtgtgggaaaatggcctggaggccaccttctagggaatgtatttttagccctattttacaaaaaagaaaactgaggtacagagaagttaatttgcccaaatttgccccatggttgctaagttgcagagccagcatttgaaccactgttcccaagtcatactctttctattgcttgtaactgtcatcgtagaccactaaagtggatacctccacaactctttgctttccactgcatctggactaccacaatagctccttagtctccatccttctctcttctccattctatcctcttaggctaccagtgcacttatccaattcccacaatatccactagctcaaggccacacatttaagtgttcaactctatatcccttctcctccctggaatgtgtctactccacccagcccatttactgtccacacatacaacctttattcaggctgcagacatttcctacacctgaaaacaatgccagcggactccctcctcccacagccattaaaaccacagtcttccttgaagacctacatccaagttcaccttcttcctgaaacccagcacactgagctatagtccatacctccctctccctgctcgaactacagtagcactcccaggctgaatgatttatatgctaccttacactgtctctaggcagcagccgatcatgtgtctgattttctcagcaggttattatggttccttcctgggcccaggctgctgaatctttcatgttcttgtatttcacagcaactatcacatcagagaggctcaataaatatgtatggattttttgactattctctttcagggggaaaaagagagaaagaaaagaagaaagggagggaggaagattactctctgaccatttctcgatagcatacaaagtcaggaggaagagaaataaaatgtcgttagtggagatttcaaccatatgggaacctactaaacacatgtatttgttaatgttttggagttacctgacatataggtataggtataggaaaacctattccaggtattcttcaagaggtgatagttgttgtgtgaaaaatgcattctaaaatcaaacaggtttagataatgcttgttaataaaattaaatatctcattttgctgtggaccttctagcttttggtaggttcgtgtccattagaaatcactgtaaaaagcctacatatacaatatttcccaagcttgtttgaccacaaaacgtcattagtaaggagaatcttataaggacaatattgattggaacattctttgggaaatgtttgaaatgatcttcccagtaacctcagtgtaagtgatgctctgtcattaaccaatgacaaatacatattcttcctacatagttgacttttcatgatttggtgtggtcttgtaaaagctattctattttgttgtttgtttgtttttgagacagagtctcactctgttgcccaggctggagtgcagtggcaccatctcctccacctccagggttcaattgattctcctgcctcagcctcccaagaagctggaactacagacatgtgccacacacacctggctactttttgtatttttagtagagatgcggttttgccatgttgtctaggctggtcttgaactcctggcctcaagtgatctgctcgcatcagcctcccagagtgctgggattacaggcgtaagccactgtgcctggtctaaaagctattctaaatcataggttgttcactcacatttggctcagaactggttaatatttgagggttgatggtgatgatggaaaaatagtaactgttttaggattgagaatctgtggaaaaggaaggaaactctcaaatattaactaccttatttaaaattaacttatttaaacaactctgcaaagtggttcagtatacctactattgattgaataccttctatatgtcagatacagcccttggtactttacatttcttatgcatttctcataataaccctgtaattctcaatgtatacaatgtgctcaggtcttttaaatggcttatttcagataatacaactagaacaatggcaaggctggaattcaagttctgagtgactcaaaagtccatgctctttctgatctatcacactatttcccatgaagagctcttataggttgtggattcttctgtgtgtataataactttcttagccaaatctaaatctccatagatattcttgtaaaattataaaactaatttatcttattcgtgtatggagccagttcatatacaactggataagccaaatataaccgatatactcttgagttctgaaatttgttctctataatgcacacacagttaacaaatgtaggtttaccagtaggccaaaatagtttatcactcatatgtgttgcttgtaatgcaagtaatgagattaaaaattgtacataagaaattacctttctgagactctgttcatagcctgtttaaaagggcctagtcttttcgggaaatcttttgtgtgttttttcttttctttttctctttttttgggacagagtttcgctcttattgcccaggctggagtgcagtggcacaatctcggctcactgtaacctccgcctcccgggttcaagtgattctcctgcctcagcctcccaagtagctgggattacaggcacccgccaccatgcgtggctaatgttttgtattttctttagtagagatggggttcatcatgttggccaggctggtctcaaactcttgacctcaggtgatccacctgccttgggttcccaaaaggctgggattacagacatgagccaccatgcccggctgtgtgttttttcttaatcccagtcttcaactggacaaatgtctctttggcattacttcttaacccttaggtatctcatagtgagagagatataaatgctaaacagagatttatgagaaagttaaaaaaaagaagaagaagaaagcagagatagcgattccgaataaaagattctggggcagtgttgattaaaataattgctttcttttcttcactcaggaaagtattcttaacttggagtccttggtgacttcagggaagtcagtgaacacttttagagtgaaaaatattgataatatgaacttatgctcatttttctgggggtgtttgcatcagatgcacctttgtgcattcatctgtttctcccaaacatcatactggtgtattggtgaattcttttaaaattttactctattttgtaaggatcattacatatgaatgatataccataatacttgtcatttttattttaatgttaatatttcacttcagtaagacaccatgatctgcttgaccattaccaaattttggcaatgttagttcctaatactcttttaaaaaaagagaaagagtttgaaagcaaaagactgagaacaagagatagacgagggtgattacatgtaggaagccacacccaggccagtattactgtttgaatctcgtttggaaataaatattcttatctgatagaaaacaagcatacttactgattattcactcacaaatatttgctgagtgcctgtaaatgtcaggaattttctagacagttatagaaaggcctagacacaaatataaaaatgacattagaaaagtcatacaggcagaagccagcaaattatttccaggtggaaagattggctaagatgggcagtcttggatgggatagtcttagatgtaaataaaagggaaaggtattgaaaagcagccgaaaaaggcctatgtgaacagaagtgtgacattaatacaataagtaggagagagttgtgcagcaggttcttaaaagaatgaaacaataaaaccagggtttaaggaagattattctgactttataaataggactgtgttgagaaaaagtgaatccaaggagatccagtagtagaccattatatgaatctagaaatacacagatgagaatttgactgaaggtgacagttacagaaattaagaagaaattggtaagtcaactggcaaagtattggatgggaatatggtaggggtaggagtggagataagcagagtgagtgtaaatatactccagaactttctatttattaatagctttatttctgagaatacctcaatttcaaatagaaaacatgtacccctgaagaacagttgagctaaactcacagaattccaggatcatggtattggatgggatccttgacaagtaactggtcagtttaggaattccctctacaaacatagctgaccccatccaggctaactataatgaacaaccttaaaaccaacacctaacccagatagtacaatttcagaaatcagataataaatgaatgttagagctgggtaggtgctaaagataatctgttcaaactccttgttttctctaaggaatactgtatgcagtaattgacaaaggtgaagaacaaaagactgttatatcctaagattgatagtatatgatggaaacacagatgctctcctacagtccccccagggaaataaaattgattcctaaaattacaacaagaatacgtaaatagcatacataattgtaactttttttaaacctgtttgcaaaaattgtcctgtaactttgttcaaacaacttcccagacaaaagcttcctcagtagcattctttaacaccctctttagtcttgtgttgctgaaatatgtgtttggaatgaaaattatcttagcgcaaacctgtgggtatatacggtctgtactgaatatcaatggcaaagccttgatatttgtcttagctcaagctgctataacaaaataccataaactgatggcttaaacaacaaacttttatttctcacagttctgggagctggaagtctgagatcagggtgtcagcatagtcaggttctggtgagggcatcttcagggttgcagactgcccacatagcatgtatccacatggtagaaagagagcaacctctggcctcttcttataatggcacgaatctaattcatgagggctccattctcatgacctaattacttccgaagggctttccctccaaataccgtgacaccggggattagatttcagcatatgaatattggagagacacaaacattcagtccataacaatattttcctttgacatttcctttttctttgctcctgagagtttttcctcctaactttctgcagcttctccttccccttcagggactgcttaggattttctccttatctggtcaccaacctcttaactggtctttacttttctgatctgcctttatactattcccagagtaatctttttgaaaagcaaatctgaccatgtgacttcctcacttagaagatttttaatggcctctttagaagaaaatattgtcttagaatagtatacaagtcctccaagactagttctccatctttatctttgtccactgtctgatctaaactttatatccctacctgtttgtagcttcctgaatggcctgtgttctctaagtgaacttcttcagaatgaatccctgttcattccttgaaattcttttttctttctaactaccctaaaaactgttccaggtaactattaagtttctggaccccgaggttatacctaggtattagttgataggctcactaaaattaatagaatgtttgcatttaagttagagacttgagtccaggagaaagtgaagatacaatggaggaggaagggaaaagaatctattaggcaatcaatgcaagattatttaactcacaacctctcacttgaactaaaataacttacaaggctcttgttattatctccaatctataggtgaaataaggccctagaaagattagtagctgaattgcctggaattgcttgtatgaagtggaatagagattggaatctttctccactcttccagtttctttcaaagaataatatcactcacagttgcacacatgtcacatgaagcccccaacctagatgcctaattaaacttagctcaaactccaattttttggacaaaaggcctccttattcttataaaagctttctcctctttctttgactcttctcttatgtcagctcagagagacatttctgcttgggccaatctggccttcaagctcagtcccttcaatgaataaaacaaaacaaaacaagtcgggattttgtaccttcagtaaccttattgacgattgggagaaagggaaaatgcacgggttggagttaccctttagaccaagctgactcctttctcttatatgcacacacacacacacacacacacacatcttcaataaccttattgatgattgggagaaaggaaaaatgtacaaattggagttaccctttagaccaagctgactcctttctcttacacacacatacacacacacacacacacacacattctctctctctctctcactctttcatgcccttacatacatgcacacacagagaccaagctgactcctttctcttacacacacacacatgcatgtgcacaaacacacattctctcgctctctcatgcgcttacacacatgcacacacatacatattccctctctagcaactggcatattcctcccctttcctgtgtagatgaggcacagattagttccacccaaaccaaagctcttcaaagtctcaccttctgtcataaatagctttatcgaacattttaatgcaggcagactctcgtgaaagaaattctggtgaattccattgtttttttctccatcttattacagtatgattaataagttagtgactacaaggttgtagtttttaagagcaagaagtccactccctttcaagtcacattgggcagtccttctgttcatacctgacatattgtgggaacatatgtctgcgtaggattttaatacagagattgtcttagataagaataatcgtcagagaagcaaatggtctataagttatttaattttattcttaatatggtcaaagataatggttgcactgacttcaactttactttcttaaattccattaattgcatagcactagaattttccatataaaataaaatcagatcccatgtcacacagtactctgagtcactctgtgactcctactcttgaagatatagtcctacctgcagatgcctgacatggccagtctttgagatggccagtggctgaggatttctcagatttctccagaatctgttcccctaagcaaggccctactcatggttatttcttttttgacacacacatcttttttttttttttttttttttttgagacagagtttttatgctcttgttgcccaggctggagtgcaatggcgcaacctctgctcactgcaacctctatctcccaggttcaagcgattctcctgcctcagcctcccaagtagctgggaatataggcatgtgccaccaagcccgactaattttgtatttttagtagagacagggtttctccatgtggatcaggctggtcttgaactcccgacctcaggtgatccacccacctcggcctcccaaagtgctgggattacaggcgtgagccaccacgcctggccgacacagacatcttgttcatcataggtctgtgtgcttgctcatcttttctcttaaaaatccttcccactctcttttatttcattcttgaggactcagccttttcccactccacctctgtccctgtctgatttaaatagtcctcttttactgtcccatagcccacatgcttccttctgtgagagtgcactctacagttgtttgctgaaattacctcctctgctggactctgggtaagggacacactcttttcatcatcttgtttctgcagcctctaataaagtgcatggcacatagtcagtgctaaataaatgttgagttactggtgggactaaaagtcaatgaaagccaacctcatgtttatttcatataaaaattctactagaggcataggcaacattcggaaaaacaattgtagttagtgagaagataaaagaaaaagaaaaccgtcacaaaattgcacacatctttcctttggaagctttatgaagtactaaataaagttttatatattttatacaattttaaaatacttcaaaacaataatttgatgccagaaatacacttggagatgagagcagcttgccactagcaaactctgcttaaacctattacatgtacacattgaaagagaatccaaagccttcatgtatttcccatcagataaaatgtatagaggaaaaaaaattaagtcagcaaaagttagacctaacctacacaaatcttttactgtagcaaactaaaggaatgactagctcaaagcaatacacggtgaaacagaaatcattttttccagttctatctactgtagacagtatcaattccttccgtagaacaaaggggaaattttgtaagaattaagagaagagaagctggaactggttagggagatttaagtatttgctcttaggagctttttgttgtagttcttttatttttaaaaaatctggatcagtgctcatcatgactggccatcagagaaatgcaaatcaaaaccacaatgagataccatctcacaccagttagaatggcaatcattaaaaagtcaggaaacaacaggtgctggagaggatgtgaagaaataggaacacttttacactgttggtgggactgtaaactagttcaaccattgtggaagacagtgtggcgattcctcaagggtctagaactagaaataccatttgacccagccatcccattactgggtatatacccaaaggattataaatcatgctgctataaagacacatgcacacgtatgtttattgtggcactattcacaatagcaaagacttggaaccaacccaaatgtccatcaatgatagactggattaagaaaatgtggcacatatacaccatggaatactatgcagccatgaaaaaggatgagttcatgtcctttgtaggaacatggatgaaattggaaaccatcattctcagcaaactatcacaaggacaaaaaaccaaataccgcatgttctcactcataggtgggaattgaacaatgcgaacacatggacataggaaggggaacatcacacaccggggcctgctgtggggtggggggaagggggagggatagcattaggagatatacctaatgtaaatgaggagttaatgggtgcagcacaccaacatggcacatgtatacatatgaaactaacctgcacattgtgcacatgtaccctagaacttaaagtgtaataataaaaaaaatctggatcagttgttataattttttttgtttttttgagtcggagtcttctgctgttgtccaggttggagtgcagtggcccaatctcagcttactgcaacctctgcctgccgggttcacgccattctcctgcctcagcctcccgagtagctgggactacaggcgcccgccaccatgcacggctagtattttgtatttttagtagagccaaggtttcactgtgttagccaggatggtcttgatctcttgacttcatgatctgcccgccttggcctcccaaagtgctgggattacaggcgtgagccactgtgcccgacctcagctgttataatttgtattttttttttaaattaagggcatacaaatagtgtccaaaataagtggtattttttggacttgttctcttcatgtataccaataggtctatctaggaattatgacaagccgatacagtcctttagcagaccttcaagtgttggcaaagaaactaatgtccacatagttacacatcccgtacagtggatccttttacctcaatggtcaacatcactgtgagttgtgggtaagagtaatggactgaacatttcacaaaaaatgacctcaacctctagctaactgctgtggctctgaggtgattacttttttcctttttcaaaaggaagctgcttcttcagcatcttctcctggagcccctggcacagtttcaggccatgtgtcaggggaacctctaagcatatcactgtgacagaagccaagtgctggcccgcaagaattgaggactgtttgttcacagaagagcctcagcagaatgcgggtgttacatagttcaaaggtgccttgaagaaaactgatgctgttgtagcaggggccttcaaggctcaatttatttctcagttgctgttccatagccctctcccagcctttagggagtttagccaatagtttttgcttgggtgtttttctctgtttagttccttgacttagcaagatttggtgcagttaaagagttttcatgtatttttaaggagagccacagtgtatactactctggcaggggttgaggggaagtattttattaatgaatgcagtatgtgttcttggtaaaagccaaaattaaactggctcactgtttttgtcctgctagctgtcgacatttaggtgtgttgcttggtgtggtgactcaatttcctgtgggatagttggcaactccactttgaggtttgttcggcgggatgaaaaggtcagttacttgatgtcttagaacacttggggttaaaattcctaaaagtgaagctttacaaatgatcctgaaaaatcgtggctagctatattgcctactcacctaggaatttggaaaaaagcaatattctcagctctatgctaatatcaagaataattctttatttgagcaacagtttcacagagcaaactttactctgttagtaattattttctcactagcatgtagatgtgttccagtgatttttcatttttcttatttatacagatgttagaacttaaaatatatgcttaccccattttatcatcatactcaaatcctgtctgtcaaaagtggctggtgcatggcttggacataaaatggatattctgaagtaaattgttcctcctgtcactatactaccttcttaagaacaaatcctgtgtataaagtgcatgatgtcttgaagcattagccaaaactttcctgaattattttccacattaaaaaataacaactgaaatataatgtgtggagccacatcctgttagatttgaagcctgagtctgaacagctttgggaacttggtgaagatggaggaagggggcagtttacttagctactgggaaatcacttgaggctcaggctttgagaaagttggagtgcaggggagaggagccacagaaagccgaacctcagaggggactcccagcttcattgtaaccaatgattgaaaagatggcactgaacaaatcccagacacaatggttatgcatctttaatccactggataggctaactatggacagctcaaatgatcataaaacaagtcaatgtcctcttaaaatttcctacattcctatattatgggaatgagagagagaggaaaatatcaaaaccaaaccatatagtagatgcactaccatggcaactaggtgatgctatacttgcatatggaagttattcagtaaaatgaaaatgattgtgttagagccataggcgaaagtattgtttgtgatctttagggtgtggggttacaatggacttcctatatttgtgtgtaatgcttcaatttttataacaagcatgtaatattttttacattcttagaattggggaagctatacagagcaggtattttatatttaccatttaaaattattaatatctttaagcttgttaagggggaaaaaaaagcttcaatctgaaactttaattcacctggcaaggtttaggcagttgtttgtccatctaaagtatatatttacatagactgcggggtggaggaagtagaacaaaaaagaggcaaattttaacctagagtactcaaagtgaacagtaaatagttcaagtattcttgataacaataagccacgtggcacatgtaacaactactttaaaagttactctaacttttacaaagttcacataaaaagctatctcaaaaatcccaggagcctaaattcagtccatgaactttatttgttgtgccatgttaatttatggagtctaaatttcaagggcagaatttcttctccaatacctgtagattcaaagacaaagacaagggatcccaccacttagtgtaagtttctcagtatcttctttccactcgacaatgacaaagttttatcaaatggacccttgggagtttgacttctcctcactatgaatggtttgcttattgcatgctaatgtagaaaagttctcccacaactgatctgcttagggacagtgtccctggtgccctgggtcagcctttgtaaacagaacaggcttttctgtatgcctttgaatatggtctttccgttttctcaaaattgtagtgtactctgcacatggtgggtagaaacacccttccagattttcttccttggcccaagatcatctaggtcttatgcaattcacaggggaaaggagtagtatgcaggacatgcgtaaattctccttaccatgtggttctttcacattgctgttcctttaagagaactcttaggcaattcggcatatgaaaatgcagcctattgtcaaatttgtgaattataaagcgttccgaccccacaacattgtatattttgtttgcttgtttctgtccgccccaacatttagaagtctggtacttagtagggactgggctgggtagaaaaagaatgcggtcttaattcccacaaccctgcctccttgaagtaggtgaatcctaagcctttagaaacgaacccccagaaaccctaaaacttaaaccctcagaaaccttgagggtcctaaataaccttgtttgtgaaacttcgcaggaagcagccggtcgtggagtcgcagaggctccagcggtctgggcaacctggagggcagtggctcggcggggcgcgcggggttctagcgagacaggtgcgcggccgtgcgcgcctgcgtgccggtccctcctgagccccgcggcgggcgcgaccccggacggcggactgcaggcgctccacgccgggttttccgccgctctcctagcacagacagtcccacagcagccccacagacacacacgctcgcgcccgcgcctcctcgtctgcacttcaaagcgagtggcgcccggctgcgccggggggatggcactgcgaggtggcggggcccccggggcagagctcgaggggaaggacgcggcgggtggcacggacagggacaggcttttgcaattcggaatcttttcgtaagggggttgaggaggagccaggcagcgccgagggccgagaggggcgtgagggggagtgttcccggaaagctgcggcgttggagccgcgctgcgcctgccgcccgaggagttgagaaagaaaacaggaaacgtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcggggtatggcaggatggccccctttgaactcgctagcggacccgtgaagcgcttgagaactgagtccccctttccctgtctcttcgcagaggaggcctaccagaaactggccagcgagaccctggaggagctggactggtgtctggaccagctagagaccctacagaccaggcactccgtcagtgagatggcctccaacaaggtaagccccggttctgctgtcactggtgcccccaggctgctgattcccatgccggcgagccactggtacccatagccccgggaaataaattgagaggttttttaggcttactgcatgttggctattctgctccttagagggaggttcctgtttccttgctttgcctcccctagtcacgccagataaacattttccaaaagcaatttgacgtgctaaatttaagtatctcccaagacacagggttcctaagtaacactgagcccttgcagcagaaacccagtagggtccatgggcattgcatgtttaaaggtgttcttgggattcccggttgaaaataagaattggtggatgtctgtgaaatcacttgaatgtcaccacctagggcactcaaactcagaagagttcatcgaacttggaaccttcaccctaattcatctagttgtcagggtaccccgcaagaactgagcctttatatattcagttggccatacatatccgcaggaaacattaacagagttagaaggttccttatgatcattacttttgtttccattaatcttggaaagaaagcccagttttttgaggtcatttagtacaaggaggcttcaactaggcatctgtgccatatgtgctaaggtgctggtcttggcagttaatggagttttgagggctgagaagtaaccttcagcctgggacagccttaaaatagcacggaaggcaaggtatagtgttttcagttttgctgtattttttggatttcctgttctttttgtctttagttatgcaaggagataattggaattgtgtatgtttttagtggctatttgcctgtgcatgtcgtatgcagatggctgaaggattcagccagtaaggactggtaatgttgtgagacaattagtaatagttgcctcgtcaagatatttaagtatttttggccacctatttacaaggtcaagaaggttatattatcttacagttcatctatgtgcacatatctttaaatgagtgatgcttttttttttctacctttctatggtttttatcccacctgttctcatgcagtttttacaaaaaggccacggcataacagccacttgattgtcttatctattaacagtgcttttgtaggtagcattgtcaagtgaaaagttggcttcaaataaataaaaggggctctgtagacacggccagcagatactaacctacccatatgcacactgacctacccatgtccacactgatgatcaatttttttgtcatttgtgcctcatttctaaatttggcacagctcctcatcagaatgaccaattattgctctcttactgggacttttaccccctgctgtagcattaggcacctttattctcatctgagtaacaaattcttagttttataaaatatagtttgttttcataatttgattctcaatagcagtagacatatgctgaatatgtccagtgtcctaactgctaaatgggagcactttgccatgggcctgagttcttaattctattgtgtggttgattctgtgtaagaaaatgaagagcagaatcaaaagccacttagcaatgtgcaagcattagtgtatattttcaaggtgattcgacagtagtttttcagctaaatgaatttgagcagctagttactttccctaaaatccatattcttaatgttgagatctatgtttggatttaaaactgaatgtgaaatttaataatgtattgtaaatgacttcagctgtcaaggaattaatctatacgttaagatttaaaaattttttaggtcataataattgcctaaaatgattcctttcttttaaaggcaccagataagacagggatttaaaaaaaaaatctttattatgaaggccccagattagactttgagttaatttacaggtttaataggagaggttggtctgtttggttaaaatgaaatctaggtaaagtgagaagataattttttcaaaatgtagtcattctagcaatgtttatgtcttgtggctgaaaaattaggatattttttcctagcccacgacagagctgaattgaaaaattattgctgtcacactaatttttaacattaaacttagctcagcttaagctgttgcttaaacttttaatgtccaagccattcgtgtcttctttaacttatttatttctaaatcagtgctaagcttacatgactgttatagacaaaaaagggttagcacagaaagaaaaaaaagctcttgctaaaggttgtaaagttacccttcttcttcataacaagggcatgaataagccacatccacaaaagctgtaaactgagttggagcagctgatcggaaggcccctgtgagtgttgccacaccttcagtctgaactggaaatgtgtacagcttgcatcatctccactcagttatttgatatttcttgagtatgaatgaatgagtcagaaacattgcttttcagttgttagttttattaccatccattctttttacatacacgtgttcaaactgatattttcagtttattctcctttagcctttgaaaaattatgacagttttctgtgttctctcttgaggttttaaaaaatttactctaatagattgaaaagcacaataaaaacactagtaagagatcaggatttttaaatggtgatagagaatacttattatggagatggatttaggtattaggaaggaggaaactgattcctcaaacccatttaacaaactgggttaacacattatttctgtttcttagacttctcaataaaaggcatcttagccaattagcagcttttaaatgatgctctaggagcaactagctgtatttcctgtattggtattatatatgtttcttgcttgttgatggcattgaagcaggaaaattattgaattcttggccaaggctagggttggctgtaacacatgtaggatgcttgtaccaagtagggtaagagattccagatggcatttaatttgagtgattaaatctatggcatttacccttataagcacattaatctgcctgagatttgtacagatttcctttggaacctcattgctacaattgagggtaattttagtgaggtctcaaagctttggaggcaggcaaacctggaagttgaattatggttttgtttcttgctaatggagttacattagagaaatgacttcaattttttttagcttcagtttccttagcatacaatgggcaccataataactatcttgaaaagtcagtgtaagagttccaaagaatatatacaaaagagctagctaatatagtatctgacaatagtaggcactgtatctgttgttattgctattatttgggttttaggtcaaacttcattggttgcctacgtggctaaaatgtctttttaccattcggttgtaatttataccagacacttcaagtttgatggatttttataattcttagataactgtctatagcgcacatttctgtatcataaaaatgcttaaattatatttacagtttttgtggtataatacagacatgaacattctgaagttctaattagaagtttaggcttttcttaaattccagttacagaatgccagacagaagagctaactaagtacttttcctgttttactctaaaactgaaaatgcagaccttactaatttttagaacatgtgaaatgtaataagggttagtggtcaatgtgccttttcagtaaaacaccttttaagcagaatagtttcaccatgtttttggttacctttctctcatggaaagtatattgaggatgggagtcagtagagaggagagcaggacagcggcctgggcctcagggctttcaaggattatgctatggaaccctgtaacgttatcctcttgtgacctaataatgcacatttcaccaggccttccctgtaagttcagtgaggttcaaaggagaaaacgaaatcattttgagttattcccaagacatatcactataaaaatgtattttgtttctgctctaattttgggggcagtttgaggtttggcatggctggaaatgactgtgtttcaagctgaaagtctgtcttgaagttagaatccagaccctttctaagagacttcagatttttctatacttcattccaaatatacttaggccagctttacaaatgtggtcatgacttctttatggaatttattttgtgtatttggcttttggcaaacctctctagcatgtttctgttgcctataaattaaattgctttgctgggtgctttgtctcagagctttctctggctgctccccctactgctttgtaatagtcaatgcagaacatatagtaggactttttgttgatgtattttcttctgggcaagaggggtgttataacaaatataggatcttcatagaagtggctaaatcttaagatatttccacattatgcaactacagtgtaactcaacagatataaatgttaaacttttgctaagaaggaaactaagttaattggaaaaggcatgttagttttatagagagaaaacagcctcagttgttttctacattaacatattaaatcttagattaaaaaagtgttaatatgcctaaatacaaactttaaatttcaaaagaaaatatcttctataattatagaaaatcaacatttagatgttttgagttcgatatctgctttttcatctactcaataaaggtagatttgggaaagatttatgtagcttacatgtagtaccttaaagttaatatgaaagattgagaatcctataatcactgttagaaaaaatactttctttgcttttaagtaataatggaagagggaaacaattttaaaggaaatttttctttcactgaaaagtagagcccttgatgttaccttagcataaaacttaggattaaaacaaatcttaacttgtctctgttgtcatccgttcagttcctgtgccagtatttagtgaaagtttaattattcccaacatttaattatcaaaaactcctaatttttaattattcaataaattaatcattactagataaatttctttttttcagttacattttgacttaatatttggggtagtagtggtaacttctgtctgagagcattatgaactgtctacgttttcgaaaaaaattccgaaacataaggattgcccatgataaaagaagtattttttctaatgttatgggtagattaaacaaactggtatttttctagagagaaaggatgatagataatgcttttgttcagtttaagaagatttctgcgatagttacatagactgtagctatcacttaagatataaatacatgatggatgtgcagtgctgtttatgtcattattttcagtggattcacaaaatatgtagggtttggttttctctttttcagcaggagggaccaactctttttctagaactgtagattgctggggttaattttgtgatagcgtagctctagtaggggagcagtttttacatggctatttgttgtaatagtttaattgacactgttagtctgagatctttctagaatgtagagagatcagtagcactttattttaatattcacattagttttgaaaggcatttgaagaagactttttttattccctgtaacagggattggggggtatgccttgatatttgcttaaacaacaaacaattctgctgcgtccattaggaaattagttaagttcagtgaccaactacaatgacaataggtttattatcttttactcttagagaatagtttatcttttataaagtatttattattattatttagtattcagagcttcttgtttttgttttgttatactttgtatgtgataaggatgaatgatatttactccctggcctggagtaggcaccagtgatacttacagcagctttgtacagtgaaaagaacataaatgtttttcattaggcaaacttggtttcaaattccagctctgttgtttcctatctaatattttgggcaataggccttaccgctctggagctcagttttttcatttataagtggcgataatgaaaggggaaaataaaatgaaaaagttattgagaccattagctataatgtatgtaaagctccgtttggtgcattagcacacactgggtgctcaataaattgcatgtgcttgcctgtctagaatatactaaaaaagagagattaagaaaaactctgtgtcacatatttcttgcaatgtaaaaacataatatttcttagaagaaaaacatgacttttctattctttaagaatttacagtccaaattaatgttgctcaaactttgtcatttttgagacagagtctcgctctgtcgccaggctggagtacagtgatacgatctcagctcactgcaacctccgcctcccaagttcaagcaattctcctgcctcagcctcccgagtagctggactacaggcgcatgccaccatgcccagctaatttttgtattttgagtagagatggggtttcaccatgttggccaggatggtctcgatctcttgacctcgtgatcctccctcctcggcctcccacagtgctgggattttgtcatttctgtgtacattcatatctgctattatatgttgaatgttttaacttaatgtattttttattaatctttaaaatttatttgtcaattattcttaattgacaaatattaattgtatctatttcttgggtataatgtgatttttaaaatgtgtacatcatagaaagatttagtaaagctaattaacatatctatattacctcaccaatttatctttttgtgatgagaatgtcaaaaatctattttagaaattgtaaaacatataatacgttattaattactggggtctccatgcagtgcaatagatcactaaaacttattcctccaatctaactgaaattttgtactgtttgatcgacatcttccatttctctctccctcctcctctacagcctctggtaacccacctttctactctctgtttctgagatcgacttttctagattccccataaagtgagatcatttattaaagacaatatttgtctttctgtgcctgacttatctcacttagcataatgtcctgtagttccattccatgatgttgtgaatgacagaatttctttcttttataaggctgtgtaatcttttttttttttttttttttttttttttgaggtggagtctcgctttgtagcccaggctggagtgcagtggtgtgatctcggctcactgcaagctccgcctcccaggttcatgccattctcctgcctcagcctcctgagtagctgggactacaggcgcccgctaccacgccccactaattttttgtatttttaagtagagatggggttttactatgttagccaggatggtctcgatctcctgaccttgtgatcggcccgcctcggcctcccaaagtgctgggattacagatctgagccactgcgcccggcctgtataatctatatatatatatatatatatataatatatatatatatatatatatatatatatcacattttctttatgcacacttgatgaacacttagattgcttccatatcttggctgttgtaaataaagctgaaatgaatatgggagtgcaaatatctttttgatgtaccaatttcagttcctttgggtgtatacctagaagtaggattgttggattttatggtagttctatttttagatttttgaggaaccttcatactattttcaataatggtggttctaatttacattcccaccaacagtgtagaagggctcccttttctccacatccttgccaacacttgttatcattcatctgtttgaacatagccattgtacatggtggagagcaacacatactggggtctgttggcgggtgggatgggtgcagggagagcatcaggaagaatggctagtggatgctgggcttagtgcctaggtgatgggatgatacgtgaagcaaacatggcacatgtttacctatgtaacaaacctgcacatcctgcacatcctgcacatgtacccctgaacttaaaagttgaagagaaaaaaaaggaaaatagtcattctaacaggcatgaggtgatagctcattgtggttttaattgcatttccctgagaattagagatattgttgagttttcgtttgtttttgagacagggtcttgctcttttgttcaggctggagtgcagtggcgtgatcatgtctcactgtaacctcaaattctcgggctcaatgatcctgcctcagcctcccaagtagccaggactacaggtgtgtgccaccatacctggctttttattttttcgtatagagagggtcttgctattttgcccaggcttgtctagaattcctggcctcaagtgatctcctgcctcagcctcccaaagcactgggattacaggcatgagccactgtgcagggctggggaacattgttttttttttttttttttttttttgtatctctgttggccattcatatttcttttttgaggaaagtgtgtctattcagatcctttgtctaattttaatcgatttgttttcttactatttggttgtttgaattttttatatattttgaatattagcctcttatcagatgtatggtttgcagatattttctcctgatccatgggttgtcttttcactctattatttggttgcttgtgcaggtactttttagtttaatgtagtcctatttgtctatttttgttttagttgcctgtgcttttggagtcctatccaagaaatcattgcccagaccattgttgtggagattttcccttatattttcttctagtagctttacagtttcaggtcttatgtttaagcctttatatctcttttgagttgatttttatatggagtgtgagataagagtacagtttctttcttctgcaggtggacatccagttttcccaacactatttgaagagactgtcctctctccattgtgtgttcttggaccctttgtcaaaaatcaattgactgtaaatacttggatttacttctgggctttctatcctgttccattggttgatgtttgtttttatgtcaataacatgctgttttgattacagtagctttataatatattttgaaatgagggaatatgatgcctgcagctttgttctttttgttcaagattgctttggctattaggtctttttttggttcatataaattttaagatttttttctctatttctgtgaaaaaaaaagacattggaattttgaaaggaattgcattgaatcaatagaggaactgcattgaatctatagatggctttggatagtgtggacattttaacattactaattctttcagtgcatgaacatgggatatcttttcatttatttctgtcttcttcagttgtttaaatcaatgtcttgtagtttccagtgtatagatctttcaccttgttggttagatttgctcctaagtttttttttttttttttttttgtgatggagtctcgctctgttgcccaggctagagtgcagtggcgcgatctcggcttactgcaagctccacctcccaggttcacgccgttctcctgcctcagcctcccaattagctgggactacaggcgcctgccaccacacctgcctttttttttttttgtatttttaagtagagatggggtttcactgtgttagccaggatggtctcgatctcctgacctcatgatctgcccgcctcggcctcccaaagtgctgggattacaggagtgagccaccacgcctggctgctcctaagtatttttttgatgctattgcaaatgggattattttcttaatttcttttttggataatttattgtcaaagtatagaaatgctaagagcaacttattgttaaatctaaatactcacccaagtgcctcatcttaagtaatggtatacatgaaatcataggtttgatgttcaagttatattttttctgtattttttctaaaattaatgaataacaaaatgagaaaacattcatcttgcaccaccttaaagcattttgcctaccatttactaacactgggcatacttttggacacactagtctaaatcagctgcaagaacaatttagagactaatttattgttttaaacaatcaacatttttccttctttaccctcagttggatttctccactagaggagaaaatggcaaattcgttcagcagaaatattccaattcataaaatattcattccttaggcagaatggtccgtggatttagagcaccctactatagacagcctgcctgaattggattcattctctgccttttaccaaacgtaaattgggccacgttgccttctgtgcttcagttttctcatctgttaaatagttgctgtggtgatttaatgaattaaaagatgggaattgtctcgactgagtcaggaatcatactagatactcagtagaactcattcatttccatatgtgaaggaataacattagtttttattttattattttggggggtgagggttagagaagggtgtctgccatcctgatttctatccttttgataaagtgacctaataatattgatactaaccaaagaggactattataatgttttatttactcttctcccccattaatcactttttttggtggtgttttatatgttttattcctttattttcatccttcaaggagtttgccctttgtttccttctgtaattttacagtatagctcatcaagcaagcctgagatttttgtcagaatatctgaaaatctctgagctttttctagcagaaatgcataatgcagtgcagaagaatagtctagccagtgtttttcataaatgaatgtacatacgttcttcctctgcataagactgaaagtaacccaggcacacaatatcttattaatatttaatattaagaaaagtatattaagaaggtaactctccattctacctctcaacatcttaccatctagtatacacacaaatatttccttgctctatcagccgagagggtctagaagctaccataccccagtagcaatgagcacacttagcaccctcattttggtttctaataccattctctggtaaaaggaaccaagactctttgaaaaaaaatagctgatttctagggactcaggaaggaaatatgtaagatgagcctggagcatcttgtagtgccaaaaagtaaggacctgctcaaacaaatggaaccctacacccgtgggaatatactgaagagttgcaagagcaaactgaaagagctcccaatggccaaagctagaacaatttgagcaagaaaataatatagtattggattatatcccaaagggtaaaataaatatccataaacccatattgatacaatttattaaataaatacctaagtgggggaaaatagacaaatctcctcctgtgcggaattcccaataacttctatagatactctactctcaaggagggagaacataaccccctacaccgtaagtgtgagctgtgcatattgacttccttctaaacagtacagtgtagaaagggaaaaaaaagaaactgtagtggagaaacctatcactacttcagccaggttatcaaggtcaacattgacagtgataagtgataacatgtaccctcgatatgatctgatgaaaatggcacttttaatctgtggtttccctactgaaaacatataaccccagtgtaatcatgaggcaaataccagacagatctcagttgagggatattctaccctcgaaacttgaccagtatttgaccagtactcctcaaaactgtcaaggttatcaaaaacaaggaaaacctgagatacctacagccaagaagagcctcaggagacatgaggactaaatattatgtggtatcctggatgggatccagaacagaaaaaaggaaattacgtgaaaactaaggaaatctgaatgaagtgtggactttgtttaataataatgtatcagtattggttcaataattgtgacaaatgtgccatactaaagtcagacattaaaaatgggaaacagtgtagagtatataggaattatctgtaatgtctacacaagttttctgtaaatctagatctgttctaaaacaaaaagttttatttaaaagatcgaagccatcttttaaggcctatctggaatgttacatcctttataaagcctttttttttaatcccatcttcttcccatcctatatctggggtgtcctatgtctcccacctcaggctttcctaattggatacctttgactttccacagaacttttatttgtaattctcttaactcttagtacaatattttgtgtctctgttttattgttctgatgaggtcttctacggtgtttttagcccaacccagtgagtgtctggtgccttagaccacttggccatcctgacaccctacacagtgagtgtcaatataacattttgtagttagtcacataaattagtacaagaatgcatgatgttggttaatgcaaatgctgttttttaccttgtattggtagatggagagtctgagcattctactttgtgcctttcaagaaaggtttttttctttttctttcagtgacaggaatcctgagcatttctcacttaatctcagttctgcttttagatactcatgtctcagaaattttatcatagtatatgctagatcaatctcatctcgtttaaattaaaagtttgtagtgcacaggcaaaaaccatagaggccatattcatggtcataaactgctctttctcatctctacctattttagcaataacattcttcttattagtttgttccaagtgaaaatgacataactgaatactttccctgctagtctgggaagaaaggatgtgtttgttggcttttgcctgtcagagagtattctgcaatgtttgcctagggcatgcttgcattcccatcagcatctctggtctgctgcactgtaatccctatagggacagcctctggcttttattactgacaagcagtgcactgtgcagccataggcaccataataggaaacaccttggcctgtcataaacaggtctggagagtagaaagtacaggcctgctggggatgtgtccatagcaaagaggcaaagatgcggctgccatattggagtaagtgcaggctaatgtctgccatctccatttcagaaaataactggctgattttgaagctgctttttgtataaacagtagtgttttggttgctttttgtttttggcttaaatatgaataaagccatcttaaagagattatacccttcaaagtattttgagaagatctataaagtattttccttttgttattttacatttaattctacctgatcattccaatccaaacccaatagagaaggaaaaacagatatttcactatagtgggaaattaggaaaaaaagaaccatgcaaaaatacaagtgattgtgtgtcttttaaaagaattacaaatcacactgaattacccaaaattacaaagaaaagtgcatttattattaaggtaacttgtgttgtctgtgcctttacatcaactccaagttttataaaaggagtacattctttgaccataaagactttatatttgttagtgtttttttcaatctttagggaaaaaatgaactgcaatattaatgataggctttgtagcaagaatttaggaagacaataaatttcaaaattggaagggttatcacagtttttaataaagagataaaattatttcatgagtgctttaaatatatataggtgtcattttattatttacaaggaaacccatttcacaaaagaggctaaagactgtaaagattgaacaaagctataatcctgttaaaaattaagataggtttaggaaaactaaagtcctaattttttttttttgaccactttggccagagctgttcataaattaggtaatcaatatttgttgactagtcccctcccttgttaaaaactaaacacttgtcctcttgtatcttttttaaaaaaatatttcaagtaagtttcaacagtatgctgtgataaggatgaaacctattaacattatccttggtatatattttgattttctgttgttttcttaatcttatattgtcagtatggtttctaagatctaagatctccataagggtaagtgataattgggttttgataaatcataaggaatcttctactagaaatatgtctgtttatttattgtacatcaggaaacgattagtttactttatgccagaagataatgtttgggcctaaatcttaatttttctatctagtgttaatacagtagaatgcctaaaggatatatagaagaaaagacaaaaaaagaagatgaagagaatgcatcattacagactgaatcatcagtccctacagaaggggaatttgttctttcaaaagtagaatttcagcagccgggcgtggtgcctcaagcctgtaatcccagcactttgggaggcagaggagagcagatcacgcggtcaggagttagagactagctggccaacatggtgaaatcccgtctctcctaaaaatacaaaaattagccaggtgtgatggtgcatgtctgtaatctcagctactcgggaggctgagcaggagaatcacttgaacccaggaggcagaggttgcagtgagccaagatcgtgccactgcactccagcctgggtgacagagcaagactctgtctcaaaaaaaaaaaaaaaaaagtagaattcagctgggcatggtggctcacacctgtaatcccagcactttgggaggtcgatcacatgaggccagaagtttgagaccagcctggccaacatggcaaaacctggcctgtactaaaaatacaaaaattagccaggtgtggtggtgcatgtctgttatctcagctactcgggaggctgagcaggagaatcacttgaacccaggaggtagaggttgcagtgaatggagatggcgccactgcactccagtctgggcgactgagtgagactccatctcaaaaaaaaaaaaaaaaaaagtagaattcatgggaaaaattatttgttgctatttagccttatttttaaatatttcagtatattgtctgtttgatacatatgaacaatctgactacaactcattgggaaacaccagtatttaccttaccttctaatgtaaggcatgattccaggtattttctcatacctcaaaccttaaatctctaatttagtcccagaaacagtattctacatgtcaaaacgttttttgttttgttttgtttttggagacaagttctcaccttgtcaaccaggctggagtgcagtggcgccatcatggcttactgcagccttgatctccctggctcaagccatcctcccacctcagcctcctgagtggatggagccacaggcatgtgccaccagaccggcttttctgttttttaatttaatttaactttttttttttttttttgtagagacagggtctcactatgttacccaggctggtctcaaactcctgggctcaagtgatcctcctgccttggcctcccaaagtgcatgagccagtgcacccagcctcagaatatttttaaagatgaaaacctaatgctcagttaaacttttataagatctatgtgcttctaaataagtgtaaagatgactattttctggatgttgtattggtggggaagatggagagatagaagaacaagtgtttattctctggttgtattttctctctctctctcttttttttttttccttgagttagagtcttgcactgttgcctggactggagtgcaatggcgtgatctaggctcactgcaaccttctcctcccaggttcaagcaattctcctgcctcagcttcccaagcagctgggattacaggcgcctgccaccacgcctggctaattttttgtatttttagtagagacagggtttcactatgttggccaggctggtctcgaactcctgacctcgtaatctgcccaccttggcccgccaaagtgttgggattacaggcgtaagccactgtgcccgacctctggttgtattttcaaaatatatccaaataatattttaaaaatgtatttagtgagcactagattccaaaatagcaagagcaatttcagcaaagtataattcctagagaggaatcctacagtacctcgttttgccttttttgttctctaggtcatgtcaggatgggagcataactgacctggccctagttcctaggaggagcatgtgccctctaacatgtgcacagaaggataatagggtcagtgggatgaggagaccaagtgactaaagcagatctgagaatctgagctgtaaaggatttggaggtgggatggagggataaaaccttagtgggaagcagacagcagatagagaagatataggataaactcacggaaggtgtaagcaggttcatgattttaaaattagcctgttaagaggttgtgttggaggtctgttttcttagtgggggcaaagtggcaagggaagtttcacttctgaatagggtggaaaatgaagatataaggaaagaaagagagaaagaggaaagacgtattaggcagtgtgaggcagagaaagagaagagtgggagaaggaggggagtcagactttccttggctggaggcaaactgaccaatgcccgttgctgcccctttccaccgcagggttcatttggtgaaacctggttggactgaacctttaggagaaccttgaagtaaaaaagaaatcccagacaggtcagtggcggatgtaaatgtttaaggaagaacagacagtcagctgtagaaatggagggaggggtagagctgactggagagcgatttatggatggtatatttcatgaggcttgagtcttttttagcactaatagttggcgtcagcttcacctgttgcctccatgagtcatgccctggtagcagaggatggtgggccaactgccaagccatcccctgaaggaccggctgcctgggagtgaggaaaggtggttgatgggctctgagacagcaaggtacaaactgaaatggggtgaaaagagactgtcaaaataagtatgggctgatttgttctaatatatcataggttattattagatgctggaagagtaaaatggaatagaagatgaaaaatgtgaacctttatcttgattccattttaaatctcctaaattctgaggagctttgcaattcctcttctggatataaatctgccctacagtagagttgcaaccttggataaataaataaatttggcctccctgagcctctgttttccctgtaaatcaggactaacataatctacctcaaaggattgtgttgaaaattaagtgaaaacttacataaattatgtagtgtggtggggacatatgataggtactgtggcctatccttaggagggatgaggaatggaactatttttaaacataaaaggtcaactttatatgctgccatataagtaacccagtgcaattggagcttgaatcaacagggctgggagaaagcttacagagtgtgcctttgaaatcccaatacccagtcatggtgatttatgagaccttaccagcttgcatatgtgatggcccactgagtttgtttactttagttttagctcagttacccagcactctatgatagcctattttttatttacactctcactaactcctttattatgatttctttgaaagaatatgaagacagccataaaaaagactcttattgaagttgagagggtctcctgtaggtcttcacttcactgtgtctaaacattggtctgttgcttgtgctttgcttttctctcaccctggatgaccttcaaggctcttccaaatgatttctctgattccctgaaatactgaaattgtgattaacagaagtttcaagtgttaatcaatatcaagatagtagttgtctcttcctggggaaactagaaatgaaaaccaaacataggcctctgtaatcattgcacagattaaaaatgaaaatgcagctgagaaacagaggaatgaatgagaaaaccctaaacctagttctagccccaggatgaggtctttgtcatgagtctgacgctagccacagccggtaagagaaggaattccctagtagtgtagttgttacaagggaatgagtcattttgcaggtaattgttcttcttccattttccacttgctgtcagccactttacagaggagtcggactttgttctgcttaagagaagtctctttccttttattgtttaaaaaaaaaaaaaaattccagaagcccttagaaagagatttgtgagatcaactggtttaccttcttcattcagatgaagtaacaaagcacagaaaagttattttgtcaaggtttctgtcttgtagcaaatacaaactttctggtgttaaacatatgaccctgatttgggtctttactgacatcatcacttttttttttttaattttctgagacggagtcttgctctgttgcccaagctggagtgcagtagcacaatctcggctcactgccacctccacctcctggattcaagtgattctcctgcctcagcctcctgagtagtgggtataacaggtgcatgaccacgcccagctgttttttgtgtttttagtagagatggggtttcaccatgttggccaggctggtctcaaactcctggcctcaagtgatctgcccacctcagctttccaaagtgctgggattacaggtgtgagtcaccacacccggccaacatcatcacttttgaatgaaatttttagtttggtgatgactttattatttgtatttgatccttgtccatttttctctagatctggtactaatttcatgtggaaaataaatcgttaggaggttttcattttgtacgttttggctgcaaacaaccacaacccagtctttaggttttcactgagggatttttgttttagcccaattattgtatgacatgtatctgctccagaggttcttataggtgaaatgagatttttatgtatctgtattcaaacacatagatagatagatagatagatagatagatagatagatagatagcgaaacatatagacatacctctgaaaatacaaccagccatataatgtaagcctgttgtgtgttaatgaatgatagggtaataatacattatgttcctgtcctgtagaggagttcgagtattcaatacagaggaccagaatgattggtcccagaaaaagtgctccttaagctggatcttgaatactgaggatttatataggcatctaatagggaagaggtggtattccaggggctggataaggcagggtaggatggggtattcatgtggattcgctttattgtatgtttgctggagaggagggtagtgggcattctggaggagtgagcctctctggaacagaggatgtgattataggaccagtggcaggtgtgagaaatgtagattgaggccatactgcagactgtcttaaatgccaggtcaagccatttgcacattgtcctataattcatgaagaacccttacatttgactataaggaaaatattatgaagaaactaaaataaggtgactttagaaggttatatctggtggtagtgtgcaggatagattatatcaaggggaaattgtactgaaagcaagaagaaaccgttagggaattaggtgtaagagtgataagggcctgaaataggatagtgatgaaaagagaggaatgagtaggagaaagattgcacagagaagggtgacagcatacataagacttggcaggaccacagccagaagaaagcatgaaattctaaacctgaataatggacagaattatagttggaaaatcatgaagagaagccagttgggtattgggggagggctggacaatatgacagttaagtttttagacatataatttaggtaaggctatgtatctaagcggaaatgccctataagctttcagttgtcaggactggatttctggttaaaaaaaaaaaaaaaaagagggggcaggattttacttgggtgttgtctgcaaagttgatagctaagaccttaaggctcatctgtgaaacgggagtgacagtgctcattaaaggttattattagaaataaatgaagtaattccaggagagtacataggactctccttgacacatagtagaccctcaataaacattaggttttattattgtttattatgggttttagggaacaacacttttgtgaattattagaaccttatttgggaagctataaaagccatctgcgtgatgtgttttcttagtacaccaaatggaagttcatatgttccattcatatacatgcttccctagctgttaggggaaggtgatagcgcatgtttaactgttgatcactgtttgtaaggcttttcgtgttttttacatatttggttaaggatcttaatccttgagctgtattttgttctcatttgtttgtgtccagagtcaaattaagtttaaggaatttataaagagcttctttgcaagaatgatattaactcaatgtactaaagctacattcacccaaagtgtaatagacttacacaacatggaagaaatccaggagaggcagacagttattcatgaagagtggtagtattcctgtctgcctgtctgtacatttgtcagatcagtgcattctgagaaaattatgccaatttgaaatctccaaaagcattctcagccagtatccgtgattctgatagtttacaaactgttgatagcataagctgttaggaagatattgtagaaattttaatgcagctgttttaattagattgctttccttataacaagtttcagtgtttctggtcacaatacaatttattagctcctgacacatgacactgctggatcaccaaccttaactctgattctctccatacaacccagtatccttaagtaaaatgctgcatatttcattgctggtaagagaggcagggccaagattcgaactcacatgaagccaactagagaagcctatgctctacactattttacatctcataattctcatacactactaacctgttgcaaatgaaaaagaagtcttattattgtaccacttttaattgcacttattattgccttcagtaaagtcttcatttctaaaatgtcttagtaaaacagtaatttcataaaaatattgccaactaggagtactaaattctaattttggttatattatgcggccttggataaggaagtttcttaggctttcatattccaaattattggactattctaaaaacatttttaagtattttgatggatgtagtctattctaatataatgtctttcaagtgtttgaaagttactacttattcaaaactcaactgtctggcagcttttcttatcctgaactctgtgaagaacttcggggacaggaggtaaaatgtctttgaagagtaagaaatccaaaacttcatgtatttacatgttctggtcttgtctcataggattcttctttctccttacataccctcctttaaatccgtacctcccccggtcttctccatcttgcaaatggcaccaatgtccatcctagacattgatcatcccagaagtctaggagttgattcttctcatttcttcagttctgttgtgcaagtcttcaagtcttgtcagttttgcctcaagcacttttacaaactatcctctacagagacagctttacaaaatgtaaatcacatcctatcattccctgctcagaaccttctaatggtatcctcacaccctctggaaggctcataccctcaggacccacgtgatgttgccttgacttgcctcggctctcattccgtagacctgtcctccctcagactggctgtgttactcagcctttgttgagagtgctgtgccccaaatctggttggcttattctaggcattcgagtctcttcccaaataccaccttctcaagtgcagcttttccttactacttaattttatagtcccccatcaatgtacgatgttaccctcttttccttcattgagagtgtttgtaatttttttttgtctgcttgtttattgtctttttgccccataagtccaaggtttacatgaacagggaacttgtctgttttgtttattactgtatcccctatgctggcacatactatgtaataagtgtttgttgagtgcatgagtgaataaccattctaaaaaactctgatgtttaaagccctttgctttatataagaattttacttggaaccctggtattttcgtttgtatttgtttgttaataaatgtcaagagttcagtagtaagataggtttcagaaatgctaagttaaacagaataaagaaagaatatgtattacaggtcctggcagagccttgaatatgctaacatttgacagtgggagtctttgagaattatcacatgaagctgctgtacattacaacacattctaggaaatgctgtcttagacaaaaacctgtcatattagaattggggtaaggggcacgatactgaccgtgaggcagcagattcctatggactacattaaaaaaaaaaaaaaaaaaaaagaacagactgataatctagggctcagaaaaaaaaaaaaactgtgatatgaaacagtggcaaaaggattcaaaaagaatacagcggttgggactatctacttttttaatttttttattacactttaagttctagggtacatgtgcacaatgtgcaggtttgttacatatgtatacatgtgccatgttggtgtgctgcacccattaactcgtcatttacattaggtatatctcctaatgctatccctcccactcccctcaccccacaacaggccccagtgtgtgatgttcccccatcctgtgtccaagtgttctcattgttcaattcccacctatgagtgagaacatgcggtgtttggttttctgtccttgcaacagtttgctcagaatgatggcttccagtttcatccatgtccctacaaaggacatgatgaactcatccttttttatggctgcatagtattccatggtgtgtatgtgccacattttcttaatccagtctatcattggtggacatttgggttggttccaagtctttgctatcctgaatagtgctgcagtaaacatacatgtgaatgtgtctttatagcagcatgatttataatcctttggatatatatccagtaatgggatggctgggtcaaatggtatttctagttctagacctttgaggaattgccacactgtcttccacaatggttgaactactttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtcatgatgagcattttttcacgtgtctgttggctgcataaatgtcttcttttgagaagtgtctgttcatatacttcacccactttttgatggggttgtttgattttttcttgtaaatttgtttaagttctttgtagattctggatattagccctttgtcagatggatagatagcaaaaattttctcccattctgtaggttgcctgttcactctgatggtagtttcttttgctgtgcagaagctctttagtttaattagatcccatttgtcaattttggctcttgttgccattgcttttggtgtttcagacatgaagtccttgcccatgcctatgtcctgaatggtattgcttaggttttcttctagggtttttatggttttaggactaacatgtaagtctttaatccgtcttgaattaatttttgtataaagtgtaaggaagggatccagtttcagctttctacatatggctagccagttttcccagcaccatttattaaatagggaatcctttccccatttcttgtttttgtcaggtttgtcaaagatcagatggttgtagacatgtggtattatttctgagggctctattctgttccattggcctatatctctgttcttgtaccagtaccatgctattttggttactgtagccttgtagtatagtttgaagtcaggtagcatgatgcctccagctttgttctttttgcttaggattgtcttggcaatgcgggctcttttttggttccatatgaactttaaagtagtttttccaattctgtgaagaaagtcattggtagattgatggggatggcattgaatctataaattaccttgggcagtatggccattttcatgatattgattcttcctatctataagctttgtgtcctcttttattttgttgagcagtggtttgtaattctccctgaaaaggtccttcacatcccttgtaagttggattccttggtattttattctctttgaagtaattgtgaatgggtgttcactcatgatttggctgtttgtctgttattggtgtataggaatgcttgtgatttttgcacattggttttgtatcttgagactttgctgaagttgtttatcagcttaaggagattttgggctgagatgatggggttttctaaatatataatcatgtcatctgcaaacagggacaatttgacttcctcttttcctaattgaataccctttgtttctttctcctgcctgattgccctggccagaactttcaacactatgttgaataggagcggtgagagaaggcatccctgtcttgtgccagtgttcaaagggaatgcttccagtttttgcccattcagtatgatattggctgtgggtttgtcataaatagctcttactattttgagatacatcccatcaataccgaatttattgagagtttttagcatgaagtcctgttgaattttgtcaaaggccttttctgcatctattgagataatcatgtggtttttgtctttggttctgtttatatgatggattacgtttattgatttgcatatgttgaagcagccttgcatcccagggatgaagcccacttgattagggtggacaagctttttgatgtgctgctggatttggtttgccagtattttattaaggatttttgcatcgatgttcatcatggatgttggtctaaaattctcttttttttgttgtgtctccgccaggcattggtatcaggatgatgctggcctcatcaaatgagttagggaggattccctctttttctattgattggaatagtttcagaaggaatgttaccaactcctctttgtacctctggtagaattcagctgtgaatctgtctggtcctggactttttttggttggtaggctcttaattattgccttaatttcagaacctgttattggtctattcagggattcaacttcttcctgatttagtcttgggagggtgcatgtgtccaggaatttatccatttcttctagattttctagtttatttgtgtagaggtgttattctctgatggtagtttgtatctctgggggattggtggtggtatcccctttatcattttttattgcatctatttgattcttctctcatttcttctttattagtcttgctagtggtctatcaattttgttgatcttttcaaaaaaccagctcctggactcattgatttttttgaaggtttttttgtgtctctatctccttcagttctgctctgatcttagttatttcttgccttctgctagcttttgaatgtatttgctcttgcttttctagttcgtttaattgtgatgttagggtgtcaattttagatctttcctgctttctcttgtgggcacttagtgctataaatttccctctacacactgctttaaatgtgtcacagagattctagtatgttgtgtctttgttctcattggtttcaaagaacatctttatttctgccttcatcgcattatgtacccagtagtcattcaggagcaggttgttcagtttccatgtagttgagtggttttgaatgagtttcttaatcccaacttctactttgcactgtggtctgagagaaaatttgttataatttctgttctattacatttgctgaggagtgctttacttccaactatgtggtcagttttggaataactgtgatgtggtgctgagaagaatgtatgttctgttgatttggggtggagagttctgtagatgtctattaggtccgcttgttgcagagctgagttcaattcctggatatccttgttaattttctgtctcgttgatctgtctaatgttgacagtggggtgttaaagtctcccattattattgtgtagaagtctaagtctcttagtaggtctctaaggacttgctttatgaatctgggtgctcctgtattgggtgcatatatatttaggatagttagctcttcttgttgaattgatccctttaccattttgtaatggccttctttgtctcttctgatctttgttggtttaaagtctgttttatcagagactaggattgcaacccctgcttttttttgttttctatttgcttggtagatcttcctccatccctttattttgagcctatgtgtctctctgcatgtgagatgggtctcctgaatacagcgcactgatgggtcttgactctttatccaatttgctagtctgtgttttttaattggaacatttagcccatttacatataaggttaatattgttatgtgggaatttgatcctgtctttatgatgttagctggttattttgcccattagttgatgcagtttcttcctagccttgatggtctttacaatttggcatgtttttgcagtagctggtactggttgttcctttccatgtttagtgcttccttcaggagctcttgtaaggcaggcctggtggtgacaaaatctcagcatttgcttgtctgtaaaggattttatttctccttcacctgtgaagcttagtttggctgggtatgaaattctgagttgaaaattctttcctttaagaatgttgaatattggcccccactctcttctggcttatagagtttctgctgagagatcagctgtaagtctgatgggcttccctttgtgggtaacccgacctttctctctggctgcccttaacattttttccttcatttcaactttggtgaatctgacaattatgtgtcttggagttgctcttcttgaggagtatcttcgtggcattctctgtatttctggaatttgaatgttggcctgccttgctaggttggggaatttctcctggataatatcctgcagagtgttttccaacttggttccattctcccatcactttcaggtacaccaatcagatgtagatttggtcttttcacatagtcccatatttcttggaggctttgttcatttatttttactcttttttctctaaacttctcttcttgcttcatttcattcatttcattcatttcatcttcaatcactgataccctttcttccagttgatggaattggctactgaaacttgtgaatgcatcatgtagttctcatgccatggttttcagctccatcaggtcatttaaggtcttctctatgctggttattctagttagccatttgtctaatcttttttcaaggtttttagcttctttgcgatgggtttgaacatcctcctttagctcggaaaagtttattacccatcgtctgaagccttcttctctcagcttgtcaaagtcattctctgtccagctttgttccgttgctggtgaggagctgcattcctttggaggagaagaggagctctgatttttagaactttcagcttttctgctctggtttctccccatctttgtggttttatctacctttggtctttgatgatggtgacgtacatatggggttttggtgtggatgccctttctgtttgttagttttccttctaacagtcaggaccctcagctgtgggtctgttcgagtttgctggaggtccactccagaccctgtttgcctgggtatcaccagcagaggctgccgaaccgcaaatattgcagaacggcaaatgtagctacctgatccttcctctggaagcttcatctcagaggggcatctggctgtatgaggtgtcagttggcccctactgggaggtgcctcccagttaggctactcgggggtcagggacccgcttgaggaagcagtgtgtccattctcagatctcaaacttcatgctgggagatccactactcttttcaaagctcagttggaaatgcagaaatcacccgtcttctgcatcactcatgctgggagcagtagactggagctgttcctatttggccatcttggaacctcccccagctatacctactttattggatttttgtgtctccatcagctgacatggtacttacagcctagaatgagcatacaaaggatactcattcgctattcgatgatgactgacaaacagtctcccaggatcaccatgaaataactaaactgagtttgatttatttaaaaatcaggtccaggtaacaaactgcacctgtccccttgaattgatacaaataaaaataaaacaaaaaaggacaatattttactttatggaactttttattacaaagaattaaaaaaaaataaaataataatacttaaaagaatactttgactattattttatcacctaaaggcttctcttattattttatttttggagacagaatctctgtcaccccggctggagtgcagtggcgcgatctcagctcactgcaacttctgcctcccgggctcaagcaattctcctgcctcagcctcccgagtagctgggattacatgagtgcaccaccacaccctgctaattttttgtatttttagtagagacagggtttcaccatattgccgaggctgatctcaaactcctgagctcaggcaatctgcctgcctcggcctcctaaagtgctaggattacaggcatgagccacagcgccctgccaacctaaaggcttttcacaactgggaattcactgaatgttgtatcattaaagctaatgtggaccttggataactgtatgcctgttttctgggaaataatggtggagctctttgaaagggtaaaaatggtgttttatcatacataactatgcctgaggtttttgttttgcatttatctttgggcaaagttgtaaagttaagcaaatctggaattgaaataatttgataacatcagctaatatttttcaaagttagatttttgaggtataatttacataagagttactctttctagaggtatagttgaatgcattttcacaaatgtgtacaattggataaccaccaccataatctagatatataggtaatgtgtaattataatatatatgtactatataatataggatatttataccacccaaaaagttttctcttgctttttatagtcattccccaaaccccacgtccagtgctgattgtccctatggttttgccttgccagaatgaataatacattaaagatatagccttttgtgaatggcttctttcacttacaatacttttgagttttgagttgaattataagtttcacttataatacattttgtgttattgcatctattggtaatttgtttcattttattgctttttagtatttcatttttttccagtatgtcattttatggacacaatttgtttacccattcaccagttgactgatatctgaactgtttctgggtttctgctatagagagttgctataaacattttcatataggtctttatatagacatatgttttcatttctcatgggtagatacttagaagtaggattgctgggtcatatggtcactctactttttaactttataagaaactgtcaaacctttttccaaagtttctataccattttgcattctcactagcaatgtatgagaatttaatttgctctgcatccaggccagcattttgtattgtttgtattttgtattttatacattctagtaagtatgtagtgtggcatctcactgtggttttactttttgtttccctaatgtctaatgatggtcatggatcttttcacatgcttattgatctttttgattcttatgaagtgtttgtttgttcaaatcttttgaccatcttttcactggattgtcctcttattgtgttgtaaagattttttaaaaaataatttctggatacaagtcctttatttgatatgcattttgtacatattcccttctcaagtctgtggcttgttgttctgttttcttaacagtttttttcaaagagaaatttggtaaagtccagtataccattttttattttatgcttcatgcttttgtggtttaagaaatctttgcctaacgcaagatcacaactactttctactgtgttttcttctagaagttctttagttttagattttacatttagttctatgattcatttcaagtagatgttagtgtggtgcaggataaaggttgaagtttcttgttttatgagtggatgctcaattgttcaagcattctttgttgaaaagaatatcatttctcttttatagctcaaattttattacttaaaattattttaagatgcacatattaaagtgatatgtgtaaaagattatatatttctggaagcatgcctatttacactagttattattactttaggagacagatattctctttgtttaaattgtttccacaaagcataccacgaagtacagaggggacattagtaactattttatgatgattatggtattcatttaggccaatttaagtgaattggagatcctaattttctctataaggagacaatactttttcatacaagattatttttgtggaggcttcatttatgtgaagtttttgcacccatttattgtcatgattattcttcagtgaaacaaaagtctgtagtagatatgctgctgctgctggttttaggtaaattgactaaatagttatacaaaactctgtctctaccatatatgaattcaaactgtatcaacaattacagaatactatgctaacatctaataagagagttagcccatgtagaagagaaatataaatacagctatcagatcagtctcatgttatttcagcttcaaggagcctcttagcaaaaatggtttcctttctccatacatgttgcaggtgtttactattttaaatgagacttttttgttaaaaaaaaattaaaataagatcatttagagaacgattctcagcttgttcagatgattatttggttttaaaaaagcagcctggagttcctcttaatctcaaatctccataaaacttacaagagatgttttcatttactgaaaggaatagttttttcttaatcaaatgtagagccattatcactagagggcagtaaatacaaacagatttagtggatttactggcactaacgatgttttcagaatactagcattaatcaaagaaagtatagtttttataatatgaaaatacatgtaacattctgttatgtaaaatattggttatgaatcaattctagattattgtctgcctctaaaatatttttaaggcatttgaaagcaaagggaggctgagaaacactagttttctgtggctattctgtttaatacttgaagtttaactttgcctcagaattcttcaagggacatttaaaaattagatttgcatttgttcaagctgaacagtactggatatatgagagaccacgttatatagatttgcttcttgattaataactaccacgacttttaattttaaggtgaaaggtgtaaaataaatgtagattgattataggataaaatattttccaataatgtaagtcctactgcaaacagtgctactgcctggaaaactccttatgttggagaggtccaagagctaatacacttattttaaacaatatttcttaaatatttcaaacacagtaatataatatacagcttagaattgattatattaacggatctattatgtaggctctaggctaaatataaaataatgcctgaaatagttttctttttttggcaatttagagtactctgaaaccagacagtctgggttcaaatcctggccctgttacttactactggctttgtgaccttgagcaagacaacttgacctctctgagccttagtttccccataatttagttttgtttttccctattcaaaaatgcatcttttctctcttgacctctgttacaaagtcaataatgacagcatgtgttaatgtatcagcagttcagctccatcagcagaatttcaaatatcctgaaatgtactgaaatagttcaaaaagattgttaattgcttgggtatctggtaaggactgagaaaacaaggaatagcagggaagtggcctctagaaattctgaggggtatttctaggaaaagtctgaaaaagagaactaactgaacattatgggaattttttttttcttttttgagacaaggtcttgctctgtcatccaggctggagtacagtggtgcaatcatagctcactgcagccttaaactcctggcctcaagccatcctcccacctcagcacctcccacctcccacctcagtagtatctggaactacaagcacatgccaccacacctggctaatttttaaattttttgtagagacggtggtttctctatgttgcccaggctggtctcgacctcctggcctcaagcaatcctcccgcattggcctcccaaaatgttgggattacaggcatgaggcacttcaccaggccaagaaactattttttctatttcaacaaacacacttgcatatatgtatataaaatcatttgggcatttgagagcagtggattacagataagaaacctgagctctagctgtaacgctgtccctcaagttgtgttgtcagaacttttctggacctcagttccttgtctgaatgtgtcgtcatcattacatctgcatatgagggcagctgtgtgttgttcacatagcgctcccaaacataagcgtgtctcactatatggcagggctgtctgcctgtgggcacctgcttcctcaccctgtccagagatctgaccatggtgatagtaaccatgattctttaattcaaggcactgtaaagttagcaaaaagattgaggataaacaaatccactcctagattcatactgtttatcatagagtttgcatcagcctaattatatgatgagctgtcatacaccattaagagcaaggactgggtttgcatttcaatcctgtcacctatggagcaagttattgaatatgtaagaaggtccatcttttcatgttaaaatagggataatatttatcttatcagaatgttgccaagattagaaatgaggtatgtaaagttctttgtgcatagtaggtgcctagtaaatgttgtaacttattaaagtttcttcattaaatttggtgaagccaagtctgactataagaattgtatctctctggctctattcaaatttctcttctaaattatctagattctctctgcagatagcagctaccgtggcaataggaaggagattctagtctcctagaaatggagattagggaaaatgaaatgaattttaatttggctcagagatttttgaaaagatttcttattccctagaaatatggaaactttccttggtactttttactcaatatgattaaataatctcccttattgcagcaaattagggacttatttgaataagttaaatcctttcacatccagcacctattagaatgcctggcacataatagttgccaaatagaagtctgttgaatgaagggaccatcactcacattcagcagggagaagaggctgcagattttagagggaagggaaactgtatgtgtgtttctgcataatgttttaagacaaggagtattatctactatatgtaatctgttttaaatgtttttgatgattttgctgagggtgaaaacccttgtcctttcctgtcacctataatcagtataaaaatattgatgttttgcatctgcatcagccaacaatctttttgtggcaatagtacactaccttgagaaatacagggacataataagatacttttctggcctcaaagatcctccaccctggatgaggagtcaaagttgaagacagttgaaaaaaatagaacagtgattcttaacactggggaacattcaggaaatttcaggggacagtgactggggagtactcctggtgcttggtgggcagaggccagggaggctagatgtcctgggatacatgggacagcctttcaccagggaggtttgctgtgtgtcccacacaacttccaaaaagtcccagcagctattcacataggtgaaaaaacaaaatgcatttataattctctgagcctagaacccaactactttttacgtataagtattaaatatttttacatggttttaatccacaccaaattttctagtaatgcagcaatagtgtatattgtgaagatggcactttgttacatttgaaacctttcaaagaatcattcatcatatcaggaaaaaggaaaatttttctaacataacacccctgtattcattttcatgctactgttacttttgtggtaattctccccataagagaaatcatagcaaacccttagatagcacttactgttctaagagccttatgtatatgcactaatttaatcctcacaacaaccctgtaaggtagaaactattattctcattttccatgtgagtaaactgaagtatgggaaatttaaatagcttccccaaggtcacacagctaatcagttatagtagtttttgactactttttaaaatgtagttgtgtacaagtatttatattttgtagtatttgatagaaattactcatttctcctttatttcactgataagccattatactgattttttttttaaatctatgtagggagtatttagcctatatgtattcagtacagtattatgaaggaagtgtatttaggaatttcatttcaggatgaatacttgttataaaaagtaaaaagtaactgagtcttaagtttgtcaaagaataaaattgatggatggatggatttttttttttttaaaggagggggaaggcagtgagcctgactgcagagtgtaatttgcatttaaatgacaagtggtatgacacttccacctgttcttcagggagcctcaccaagtatgttttgcctcgaggcctttgcttttgccattcctcacttggttttcccttctctaccctacctctcaccccgcaatccacatggcttgtttcctttcttcagatctcctggtatacgtcatctcatcagaggggctttccatgatcaccttatagcaacctctatccgtaatccttatcccttctttctctccattgtgcttatcaccccatgacgtattatgtatttattaacttagttttggaatataagctgcaggtgagaaagctttgtttctctttctcaggcagtgcctgacatagagtaggagcttaataaatattgaatgaaggggcagatgtagaatcgttagaatttggaaaaaggctggaatatttggtcctaagatgtactttgaatgatttaaatctgactgagaaaaccagtttgaggttggcagagtagaagaaggagggtattttaggccgagaatttggtaagacagagatgggattgtcagctgtatggtgaaggtggaggagtactagtctttcaggaacagagcaaatgtaatagagcagctgaaaataggcttggcgttggggattaaggtcagatatggcagtctggaatttacagagggatgtgatgaagcaggcattactagctttgaagtaacaggctgcggctggatttgaggaaaattgatctggcagtagaggtcaatatgagactagaaggggaaaagccaggggcaagaagatgagctaagaagcaattacagcattttggccctgagacatggagtgctgtgatgcaattgaaaggaaatataacatatatattttaaaaacaaatgacaaaccagagaatttttttaaatattagtataatagaatgattatcataatgatcattgtcactgtcatctttactgtctgatacctacttatcttcaactttgtaccatttgttgttttaagtgctttgcatatatggtctcatttaatcctcatatgtatctgttctggttatttattgctatgtaagaaatcacttcaaacctaatactttgaaatatgaatgtatttttattagttttcatggctttgtgggttaactggtcttggctagacattcttgcttggcattcctcatatggttgcagcccagtgggtagctatctgaaagctgaactggctggatggctaggatggcttcttgcccctcaggtctggctctgggctggggtggctggcattgctgaagactggccaggcatgtgtgctctttcttgtgcaagtgctctcttgcgctttctctcttcactgtctgtgaagttaacatggacttcttgtagcatagcctctcagagtagtcagacctttttttttttcaacctaatggcttaggggtcccaatagcacattcaaagaaagcaggatgagagctgcaagatttcttatgacttagcctcagcagtcatgcaccatcacttgttggttacacaagccaactcagattcagtgtaggacagtgtggctcattaagagtatctttggagactagctgccacagtaatccactttacagatgaggaagctgacacactaaaaagattatttgtcagtgattgtgcacaaaagatttaaacttgcaattcttgttctcagtaccagagtgaacctgggaaaatcattttttctctctaggtctcaactttatgtggaaatgagggagttagagggggtgatattaaagttactttctatttctctcagtcttttaaatatttggattcagattacgggaggggtaatggtaaggaataaactgaaagaaacagctctggataaaagatagggcttgctaacaaagttgaatgaaggagggaaggtgatgccgtataggggaacatgccgggttactcaaggattcagctagatggtttatattaaacacctgacagtgtctgacgcacatgaaacacctgttgaatggtaggaaagagtcatagattccatctgagatactggaagaaatataggctcactgactgaaatggaagtaattatactaagaactactttaaatagaaaaatgtctcacagttttgaaaaagtttgtcgtgactagcagggcattcgagaggagaatcttgtattcagaaatatggcactgaagttcaagttagaagtggtcattgaagattgtgggcctagggaaaattaaagaagttcaggatcctgggagttgagggagagtagtaggaatgatcaaacatgtggaacacttcagagaagtagggagaccagagaaaaggaggaccttagtattcctctgggggtagctttagtggaatgttggagctttaatttcttccttttgtagaggagtaagagtgatggaaatgaatacaacagatgttaacaaaagcagaggactgtagcagctaaaggccaatagaaactcagagagacacagtgttacaggagtgcttatcagagagcatgctctctaagacagacatgccacatgtggaaatagttaaatgtcaggaagactgcagagtagccataccagcaagttaaagcacagagtagtaagcacaggctttgagatggagaggaggtaaaatgcacagaattatatgctaaaatcaactaaaacctagtttttccttgtttctcacccacaagacctctttagtattaaagttacagggtaatactacaccaaaccaaatagaaaatgctgtttttctagaaagaactttgatttctcatttaaccctcctcgtaaaatgtctgattactcttgagctcaattctggattcctaagagccactcattcctttcttaactttgtgtacagttattaaaatgttctgttctggctgggcacgttggctcacacctgtaatcccagcactttgggaggctgaggtgggcagatcccctgaggtcaggagtttgagaccagcctggccaacatggtgaaatcccgtctctgctaaaaatacaaaaattagccaggcgtggtggtgggcgcctgtaatcccagcttctcgggaggctgaggcaggagaatcgcttgaacccgggaggcagaggtgacagtgagccaagatcgcactactgcactctagcctgggcgacagcgagactctgtctctaaataaataaataaaatattctcttctgatcaaaatacagatcctgagttctatatacaaaacactgcattccttatgcatacacagtgccctagctttcacatttccctccccccagaattgcaagtggtcccacccctagattttgaaggttttagaactctgtcatacataacaatagaaacaaaaggagctgagagcagccatggcacacaggtgagggaatgtgtcattgccatctgtgccatctgtgaattctggacattagtcgtattgtttaatccctatgcttttatgttggatgaggggagaactacagtcatttctacatcaccagggagccacttgttttggatttgagagagggaagcaattaaaatgctcgattgccatttttggagcagtttttatttggaaggaagggaagccagaggacattaaaattcatagaaaatgccctccaaaaggatgggcaattcttaagaatgaactacgaattttgaggagttttatggtcattattcatcactgcaagagggaagccccgttcatcttttctcagggtggcctcagagctgcagggataccattattcaatggcgtttgtcgggtgaggagaaagcctccccagaggctggcccttgccaaccaatcccaaagcagcctgcaccgaggccacaccccctcgccttataggctaagagctggaatgcaattggtgcagagttggggttttatgggaggggcttcttgtcactcttcccggcttccctgcagttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaaggtaagacttacttagcttttgaaaactccttactctgattacaaaattatttagaaagcttagactctactgtaatttgttcaaactatcagttatgtattctttccttacacatgaactaggaagaaatacgtgttaatagtggtcaagataagattgtataactttcatcagttgtagtttgagtgttaaaatagcttttttagatacgcagtagttcttctgtttgtcatgtggtatatgtttgaattgtgcttgaaaaatatatggtaattaaatacattcattgcaaataaattattgggccaaattacttatactgatttatggattccagttagtatgttgcacataaagtttataaaattaatttgtggctgtttctaaaaatctatactactttaacctgacgaggaatacgtttttttcacctttagctataaagccctaggtgacattaaaaattgacattacttaactatgtaagtgatactaaagtgaaaacttgattgtctattatacttgcaaaactgaacaaagtttttattacactgttttgtgaatctcaagaaatgaattaataaacaattcaataagattgtgtccatgcttggcaggctttttccatgccctgtggtaacattagcattgtgatcctgtctccacaatagaaggaggtagaaaaaccttattcagtcctaaatgaaacatcacttcacagatttttggtatttgagccactcgcttgaacctgggagccaatcacaacacattttaaaagattcattttctgttactctgaggatttttcagattggagtgtttgtcgtttgctttgtttctttctttttgaaggacaagttcccctttgttttagagatttacttgaattctaaaaaaattagaaaacttatttcagtcttggttgtccaagtagtcatgattccttacctccctttaaatctgtggatgattcagatttttaaaaatgtttttaaaatatatagacttccattatttgaattttgttagccatttcttggctaaaaatcttcagaaatgcagaaaagtatagagagtaaatataagaagccctcattatccgccagaattcagctcctagcttttagccagctcacaactgatgttatttttgaagggcttcacatttgtactgtgattatgaaccatttgtactatgattatgaacaatattgccaagaatctacatatagaattttagtacgtttctttttgaggaaaatttttcctggacagctttatgtttaatactgtacctttaaaaacatgtaaaaatagcaaatatagatatatttggtcttatgcattttgaaggttttatttttataccatcaatggagtatttgtttaaataactttgaatactgatatctaccaaacttgtaatgcatcacagtgcagcatattcaaatgatttttagcagaatattgtcaggaaaaaataagaaaattttcttactattggacccataccacctccttaaatatatattgggaggatatataatatacccagtagcacactggcgtgatgtagaagtaaaggagattacatttaaggacattttgttttattattttagtttgcttcctgaacaatcttaaatgcctaatgtaaattgaagaattgcagttctgaaaagcaaaatacagtattgagattcaactgcatttttactttcctttatgccttaactgctgtacacagacattctgatgtataatgagaacaaaggattcaaaagcattcacttagaaatcctcccgtttttttagttgcaaccctaaatctgtgtattgttttcagactacttaggccaaaaacaattagaaattcatcaatggaaaatatttagaggtcacttaaaaaaataaactaaatgcttaaatggttctgcattttacaatcggttcgtttcaaacagcagtttaatgttttgtcccttctaaatatattaattgagaaatatgatgggatttcccagaagaatacattgtattagctttaaatcagtccttccccctttggtaattttatgtagttatcttagtaaatattatataattatttttagatgagagaagtatcacatttttaaatgtttgttgaatgatctagtgcatttttttagtacatctagctatgcactccaaaaccaatttgtgagatcaactaccagttgagaaagcacttatggtaatttttgtggttattcatttagctttgctggactgaaacttttatatggatagcaaaaaaggaaaacaatgttaattccttttagaaaatacccttgtgttataacttaatgtacgcttcagaattatctttaggaaattccttagaccgtcttcctagagtagagaagtaattgcttcaaatattgtcttttataattatgttaaaatgaaatgttgacttccttggagtcccttataagccttggtagggaggtgggcatgtgatggaggatttctccaatccatgtttttgtgttttaaacaaaggctggaaagtactctgggaataatgtatatgaccagaaagatgaacatgcaggatgtcacttatctagtctgtacaatatttagattcctttcactggcttttttcttcagttatctgtactaactggctattttggtgaattgtttaagcaaactgccaggaaaattatacttcgttctttatattcttttagaaaaatccaataatatatgtagcatatctgcaggtagcatccacatgttctctttgggcaacataatccttatactagtttgtgtacaagttagaagataaacctgtgataactgggtctctatctatctttatcaatcactcccagaaggcttcccttgttttgctttattgagagaagtgcaaggagggcagcagttcctgtatagactgctgagattctagcaatggtgaaagctttgcctcatctcctatcttttatgaaaaaaaagactttgtcatgaccaggtagttcttaatagcaacttttagctcataacatgaacaattttaggtcaaagagatatttcattgaatgtgtgtttaaaatgtttagcagactcttttctttggaatatgctttgcctaatgagtatatttttccaagtgtgaatttatctgtaaagcaaattttttttaattattatactttaagttctggtatacatgtgcagaacgtgcaggtttgttacataggtatatacatgccatggtcgtttgctgcacccatcaacctgtcatctacattaggtattttgcctaatgctgtccttcccctccctacccgctcataggccctggtgtgtgatgttcccctccctgtgtccatgtgttctcattgttcaactcccacttatgagtgagaacatgtggtgtttggttttctgttgctgtgttagtttgctgagaatgatggtttccagcttcatccatgtccctgcaaaggacgtgaactcatccctttttatggctacgtagtattccatggtatatatgtgccacattttcttaatccagtctatcactgatggacatttgggttggctccaagtcttaagcaaagagttttttaaacctgtgtatgcatgacattttagctgtgcttttgagacatagctatggtttcccatactaatgctattccaaattctttatgggatttgagaaagaggagctagctatttaagtaactatttttatggttataactacagtcaaatccttcatctgtctgacctgcaatgataaaaatcagctattactttaaaaggcccaaaagttatggaccaagtgccagaaagtgagctgggagaaagaactcaaataatattgagcatctactatgtgccaggctaaatagaagacacttctatattagctcattaaattatatgatagcccataatttactcaagaaaatataactttgtaaagagggacagaaaaaattttgaactctattataaatgtctacaaatattcttagaaggcccaaagtttatttttttcagtaggttataagatataatgctgagtgaacacaagcagtaacctatgttctgtataccacctgatgccagttttaaaaatatgtattcacatacaagggtagaaaaaaggcataaaaggaaatttaacaaattatctgtggttatcttccagcagtggggatttacattattttcttttttttggtatagctttctacattttctatagcacatgtacattttataattagaaaggagttataaaaacatatgaacaaagaagtgaatttagtgttcctgagtttgagactaagctttctagaccagtaatttaacaaccagaatttgtactggtcatgccagttctttgtttttttgtttgtttgtttgttttttccccagcatttattttatttttattatactttaagttctagggtacatgtgggaattgaacaatgagaacacttgggcacaggaaggggaacatcacacattggggcttgttgtggggtggggggaggggggagggaaagcattaggagatacacccaatgtaaatgacgagttctttgtttttgactacgctggcatgcgaatacacatttctctcatccaacagtccattgaaatggttgagggttttttgtttgttttgataacagttaaatgcggagttaaaacttaatctagatggtctataagattgactttggaagttatttagcaaacggtatagagttaggccatcttggtatgaattatgcagagaagcaaaataattctaaataattaaatactaagaattatatttcaaacatcactaaaatatacattcaacacttaccttcatacttaaatgagaatttatggtgaaatttcaaattttaaaggctaatctgatgattagagtaaatgcatctgacttttttttgtcaagtatctaatagcagttactctatgtgtagaaaaaatacattgtttctgtatattaaggcaaatattaaaggcttattaaaaggcctcgtcgggttgttttcagagtcaaaggactctgaaatgcttaatgcttaagaaacagctgatgggggtgggagaagtgtaaaatctttgggagatttggatactggtaatgccatgtggtgttggtaggttaattccagtgtttctttcaatgaaataggcactatggcatcagtaataaaaactgtgaagtagattgttgaaaattgacctgtttcctatttagtgacttgggaaaatggtaaattttgtggatgttgagaaacaataagtgttatactcttacttgaaaaacaacttttaaaaggaaacattatacagtatttatttaaatattttacttctccatagtcctggaagagtactcaagtctattaagttttgctttggagtaaaagactaaattttgagcccttgatcagtatatatattcatttctgctaatgataaattaattgaagaaagcattccatgttttattgtatggcaacacttttatgtgctataaattagtttctctcttctctaaataactaataatacatcttaatttttaattcccttttctttgcttatttctcctgattttcccttcagcccttgggagtctaaatttgtgctggtcagtctggtggccatgagccacatgtgattatttaaattaaaagtagttaaaattaaataaaattcaaaatttggtttctcatttgcactagccacatttcaaatgcttagtaaccacctgtggctagtgactgctataattggcagcaccgattatggtgttttcccctcattgaagaaagttctgctggaaggcactgttctaaattgtcaggacaacttaaaaattctttgggcatatcttcctgtatctcagagtatgcatatatatttcacttaaattttcctcttctattatttcattttacttttctgtttttcagtttaaaaggatgcttaatcgggagctcacccatctctctgaaatgagtcggtctggaaatcaagtgtcagagtttatatcaaacacattcttaggtgagaataacaacatgcaattaaatttttttcttcagttgtttgcttgtttgtttttgtaggaggattggggtgccaactcattttggaaaccaaacaagtgttagaagttctatttgttttcattcgtcatattaataattcgacactatccgcctctgagttttagagttgcaggtgacaaggtacattttcttagttttatttaggactttaggaattcttgaattaagattatatattgccattttttcatagtaccaaactgtaaaatatattttatagagagatctattcatatcttcaacaaattcttattaaatgccagccattgttgggcaataggtgtttaatgataaattagaaatgattcctgccctcgatgaatttaccgtcttgtgtacatcaagcctagtaaactggtgggcagataaaatacaattgctaaataaaagtttgctaataatagctgagtttggtgtcctgggacaactcttgtacctcatccacagaaagaaaatgcagtaaataaaggtcagtaatttgaatgtatcctggacttactttcaaaacaaaattgctgttatatatagttaacatttattaaacacttagaatatgttctatatataaggatgagttagagttgctcatcactgccttgaaatcgtggatgaaagtaagaagatatcttaggtcttttactatagaacacaattagcttatgtacgtattcacttatcaggtaatatttatgattctctatgctcccataaaacctggggatttaacccttatctcactatcatacagaaataaaaagtagcagaattaatctaagtcatccaaaacctgctgtttcagctcccacagtgttacccatttcagttagctgttagttttatatactgctgttttcatgacatttgcgtataaagtttctaccatttcaaagtatgtattgaaactgtagtccttagttggcaagaacaatattcagttcattaagtcagtttcacaaaggaatggaattgaacagtggaaataaccacctgttgtgtattctgagtctgctgtcatgctaagtcttgcagcattttttattaggacattgtatcaaagaggtaaccatggaatacatttgatattattattttgtaatggaacttatttgcttaattttgtgtttgaagacatcaaattaagtccaattcaaatgtaaatactgaactctctaaaaggaaactttttagttggaaacatttcctggaatatataatgatcaattataatccttccaattatgcatatgatataaaacagatagaattaataataaatatagaacattttctaaatttctcaagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggtatgatgatttcaaagatcaggatcataaatattaaatgatgccctttcatgaattttcacttctagtcttttaaatggatagaaaagtttattaattggggttttttttttttctttttttgaagatgggaaggcattttataaagctccttttaaagtgccttagacaggtggtttggtatgttttaggggtttggggggtgattatttgcatcttcatttcattgtttggccttaaagagttagaaatctgtcatgtcttctgggttttaggaaaacagttaaggttttgtgaatagattttatccattaaagaagtgctttgtgattgatacttaaaaagtacataaatgtgttgtaatgtcaaagtcacaaggttaagccatactgttcaattttcagtacatttaagtaaatgtgcctaaagtttgcctatgcttacatggtgtgtctgttaacatttaaaatgaatcattgtttaaaacaatctaacaatctttacactgaagtctgttttgttttgttttgttttgtttgttttgagacatagtctcgccctgtcacccaggttggattgcagaatgcagtggcgcgatcttggctcactacaacctctgcctcctgggttcaagcaattctcctgcctcagcctcccaagtagctgggattacaggcacacaccaccacacctgactaattttttttatttttagtggagatggggtttcaccatgttgggcaggctggtttcaaactcctgacctcaagtgatctgcccgcctcagcctcccaaagttctgggattacaggcttgagcctctatgcccggccacctaaggtctgtaatttttaaatgattgtgttcattgagtcatattttactccactttctaatattttagtatctttttttttttttcactccaggaactagaagatgtgaacaaatggggtcttcatgttttcagaatagcagagttgtctggtaaccggcccttgactgttatcatgcacaccatttttcaggtaaggtggttgagttctattacatttattttatttaggaacttaatgtccagtctgtagcttatgcatacattttgtcttttttaatattccccaccttttgcttatttttatacttttatccttatttgctcctttgccaagggacaagtaaagatacagaaaggtggagtgtggataaaccacaaataacatcaattttgttattttttttgcatttaagaaaaagatgtgatatagccaaattgaagcaatttattaaaataataatttagacatcatcttagtcatctgaacctgactgcatagagaatggagtactaacttaaaaaaaatgaataaagcccctgctggctactaaccttagaatatagttttttcagtcactttcttgtgtcctgcttctttcttcatatccatttctctctcttattgaccctttgctccagcttagggtgggatttaaatgagaagttgaggctgctgtagatatctcgggaccgaaatgggaaacttcagccctagagaggacgttgatttttagttggtgtgatgcaggggttgagttaatagtgcttgactggagctgcctccatgataatgggacatagaaacttttagagttggcacctcattcctgacaccatacagctagggcgtagtattcttgggttccagcaggacaacccaactctggttttgtcccagagtccctggatcttctcagaggttcccattttcctcactagacatgtgagagtgcagttgccatttccaggttatccactggcaacactggtgtgtgatttttttttttaaacatactctatggagaaatttttcacataaagacaaaaatgttaagatgattttttttcctacaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggtaaatctgtttctgaaatttcaagaacactaacttgccactcataaaggtctattaaacttttatctgaagggttttcaatggagaagataattggattcattggaagtataacttattgacttatgggggaaaatgctatagttaatagacaatcaagtctttgatggattttgcttatgaaagttggtcacagatttagtgattgatctgtttatgatattgcttctttgaaatgatccactgaacatttcataaagcacatctggcttactcactttttgttcatttgttttcttgaaatctagtctgacggcttttatttataggccaaagaacgttttataaaacataagcaatatattgatattttttcatagaatatattagaaggacatactttaatttttctaaatcctaagaagttatttcattagttgtttactaaagcaatttgattttcttaagaaatatattttataattcagtttgttttcattataaaattatgttaatacctcatcatatgggtgagtgattctcaactggagatggtttctcttcccctttctttccctcctgccaccaccagggacatttggcaatgtctggaggcatttttggttgtcacaactatcacatttttagttgtacatgatactggcatcttgttggtagaggccaggaattctgctaaaaatcctacaatgcacaggacagcctcccacgcaaagagttattgggcccaaaatgtcaatagtgctgaagttgagaaaccctggtttcgatgaaagaaaataattgctaatgtcttactaattttatgtacattttcagaatattcttagacatcttaaatatttagaaaataaactattattttcttttaaaataatttcagagttttaaaataatattttaaaaaatacagtgaatggaaaacatttgatcatgagatgtaataaaattagataaaatattttcttccaagattatactttaaaagttcacaagtatctaagactctcccttgacacattgtaacacattttgaagcttcattttgttttccatttaaattctagagatttcttatttgtttatacttttaattcatatcattgtagaatagtaatattatctatattgtctgattttccaggctgtgtttacagatttggagattcttgcagcaatttttgccagtgcaatacatgatgtagatcatcctggtgtgtccaatcaatttctgatcaatacaagtaagtaaactttattttttcagaacacatttttcccttgtacattttagaatgactaagggtctttataaactcagagtcttccagagccataatgttcttttgagatgtgtatatatgtgttttagtgatagttcatgttaatgtaatttaactgaaaattatcattatatcccttgaggcatgtgatatttgaaaaatgtgttccagttctctttaaaagtaatatattgctgtgttactagacaagggtaattaaaaatgaaagtgtgcagaaagatttagaaagttgtattggccctaaagttttaaattaaaaaaaaagttatgagaattaatggtaagtgttcctcactttatgtaggtcatcatttaatcctcttcagaggccatagcttcccttcctcctccatgcccaacccctgttctttcctttttaaaatcttctaataagggtaacaggaacttcttaatattttttcaaccatttggttttttctcactgttaacatctcaccttataagaagtcatcactgaatttggaaatataaggaatagtagagactgtttaatatggagcatctctgacattgccgcacagaaagcctgtgtagggaatgtttaggtaatgcttgagctatcccttggtaaagagatttaggtttatagaaattctatttggtacttgaagttaattggtaagtgatttaagtgaactatgacttaattccctcccatatggtagattataaattatggtagattataaaatcataaattcacttttatatataaaaaatatgcaaagttgttgaaaatgttgtatgcttaagaatccacctttctttcatttttgcttgaggctatgaataatagtcttctcgtgcctatagcaatctagctatagaattatttatgaattcaccattcatttcctgtactttgctgtagccagatttaaagaaggaatgtagaggtaaccttgctttgagagatttaattcagagctttaggattatttacctatttttatatcttataatggcctctggactatcctatagcaaaatatactctaatgactcatccatgtagaggactggaaaagtcagggatttcctgagatgtgtggttagtcaagtatttttttacaagtttagtttaggaacttatttatccagattagacaggataacatttcatgttctacctacctatgagcacctataatgaggtacttttagaactcatcaaagcatacatacaaatattaatatacattggatgcagctccctgcatttacatggtatcagtggggaggtatcagtggggagggttcattatgtcctttctaagaagagcagggaggtcatgcaatacagtgcatgctggcactttacatgagcctggcctgatttattttgatgcttatgaatgtcttgagatattctgaattttatcaatttttagtaaatacataaaatgtatttttacataaaatttttgtgttaaaggtatatatatatatctatcttaaacaccaaacattcaaactggtatgttttctttgcattctgttatatagcatattatatgttcccttagaattaagagtagatttagaagacaaattaaaacaactgatagaaaggtcactgtcttccaagtactctgatacattttttaagggtaatgaggacctgctctattcttcattcttttgagcccttaaagcagcagtctccaatgtttttggcaccaggcaccaggttttatggaagacaatttttccataaactgggggcgcagggagagaatggttttgggatgaaactgttccatctcagatcatcaggcattagttagattctcataaggaacgcacaacctagatcccttgcatgagcagttcacagtagggttcacgctcctaggagaatctaatgtccctgctgatctgacaggaggcggagctcaggcagtactgatgcgggcttgcctgctgctcacctcctgctgtgcagcccagttcctgacaggccacggaccgatattggtccacagccgatggatggatcggggacccctgctttaaagggcacttgggctttgactggcacctggaggaccctggcatcagggtccctgtgcagtctgccatttaagctaacaaggcctcagtctacagatgaatctgatactctaaagtttgagaaccaatgaaatagtggaggaaactgaagaagataattttatctccttaggatgtctgtttaaagtcattttgctggtgacctgcctgggatggaaggataactaatcctgccgctgcaaattctttctttgttatttagtaatattgcaatgatctcctttctgtgtgaccacagcgacatagggaagttcacagttgccagagtagctttggattgctaaagtttttttgacgatgaggtgtgatgaggctgtgttattcctgagggaatgaatcagcattgtcactttgtacaggaaagtatcccagggttgttccgggccccagggcattatcaaaattacagccttagttagtttggtttggctagggatcatgtaagagaattatcttcccagcatgcagtaaaggaatccttctaataacttgtaaacttgtgatatgtagcttcgtgaaatattttatcaaaatttgtgcttatttttagtttgcagtaaaccttttttaaaatttgactttttatattttatggatggcttgagcatccatgtgtcaagccagcacattctcagctcttgcctcagagctggagctgccatcctgtccaaagcctgcagctgaatccatatttctcataataaagaattctaaagacctctgattatcaaatttataaacccatagttggttacttgtcttactttaaggaagctacggaagcactgagagcttaaggcacatggggggcgctggggattcccttggctggttcccagggcagttaatcctcctgcttcttacatgtgctcttcgtttttcttaattatttcagttgttttagctttaggtgccaaatgattttatactaattgtatttacactcgttgaaagcatgctggaggttctgcaagcagagagaacaattctacctggtagagttggttaagctataataaatgatttgagtgtgggtactgtgaacaggatttagagaaattgaaatttcaggcaggaagctgcgtaaatatttttaaaggatgatgcatataaataaatccataggccaggtgcagtggctcactcctataatcccagcactttgggaggtcaagatgggtgaatcactgacgtcaggagttcggagaccagcctggccaacaaggtgaaaccctgtctttacaaaaaaaaatacaaaaaaattagccaggtgtggtggcgcatgcctgtattcccagccactcaggtggctgaggcaggagaattgcttgaacctgggaggtagaggttgcagtgagccgagatcataccatcacactccagcctggacaagagtgaaactccatctcaaataaataaataaataaataaatccataaaatgtaaatagcagcatgaacttttgaatataaaatgctggagggtatatttaacttagctttattttctgaaaaaaagtatcaaaagtacagaatatagcattaaattttacttggcaaatgaattatttttgttaatagcaaagatgcctaagtttggggcagaaagatttattcacattagtgatgcattcaaagcatgcggtttttggtttccaagagcagaggcatttcattatattaaggttaagatgtatctagctgtcagtatacacttttttatttctctacttttattttgaaattaaaattttcatagctacactagtagattgtatgtagaattttatttttctgtataaacccacaccttcaaaataaggataaattcatgtttatcaaatgtgattatatagatatagctacagagattattttattcaacaaaaatgtactgcaagcctactaaatgttataataaatattatttcaggcacttaggacacatgggtggacaagacaagacaaatccctggctcttaagagctggcattctgctagaaaaggtggagcataataagtgaatttatggcatgtgatggtactaagtgctatggaggaaaataatgcagggtgagggcatagagagtggagtgatgaatgaggcagttttcttgacaactgaatattaagttaaaaccaccacttccctctgtcatttcatggagaaatgtttgtttctgaagtccttttgaagatttatgtttatttcagttgtaacttagagacatggtgtagcatgctgtcattttctaactaactcaaggctaagcctagtaaagctgtaagaacagtgagtgtaagtcttacttacaggatacatatctatagtgtctgccccagtcttaactgtttcagctccaggtcttaatattggctctgatctgccatgtggactccatcataagacacaaaaaggcacaatacctagtggacttagttggatttgggaggcaatgtattccttctttgtgtgtgttactctggcccatttactaagtgatctgaaaagctgctagtttagatggggcacagaacaagagagtgtcacaaaaactgctagttttgagtggggctctacaacaggtccagcctgctgtgcaagctgctctgcacatgggccacatgatccagcagatttaatggtgcttgaaatgtcagtggcagataggaatgttgtttggagcctttgacagagccctctgtgtgaatcacagcacagactctggagcaagaccctgccatcatccaaagaaagataactaactactctccttttgaaagaaagatataggcctgctgctgggccttaggagatactgactgactatgggccaccaagtttccatgtggtttaagctgtctgcccatcattaatagggtattatctaacgcgccaagccatatgttgggcatgtacgacatttcatcatcaaataaaagtagtgtaatacacgatctatcaggtccgagcagacactaaaggcacaaattacataaagaagtggccctaatgccactcctattaattacactgccttctttctcccagcctacacatgtggtcgcatggaaagttccctgcaagtagttgacagagggcctggtttacggatggttctgcgtgatacgcaggtaccaccggaagtatacagctgcagcactactgcccctctctgggacatctctgaaggatggtggtgaaggggagtctttccagtgggaagaactttaggcaaggtgactcgttgttcactttgcttggaagagggaatggccatatgtgcaattatataccagttcatgggccgtagccaatgatttgtctggatagtgagggacttagaaggaatatgattggaaaactggtgagaaagaaatttggggaagagatatgtgaatgatctctctgaatggacaaaaaaggaatgctcaccaaagtgtgaccttggcagaggaggattttaataaccaagtgaataggatgacccattctgtagatactagtcaacttggttccctagccacccctgtcatcacccaacatgctaagaacaaagtggccatggtggcagggatggaggtggcaggatgtgcttagaaacatggacttccactcaccaaggctgacctggctatgactattgctaagtgcgcaatccaccagcagcataaaccaacactgaacccccatataacaccattttggggggatcagccagctacctgatggctggttgattacattggaccacttccatggtggaaagggtagcattttgtccttagtggaaaaggcactttctctggaaacagatgtgccttccctgcagtttttctgccaaaactatggtattccatacagcattgcctctaaccaggaactcaccttactggcaaagaagagctgcactgggctcatgcccatggaagtccctagtcttaccatattccctaacatcctgaatcagctggcttgataaattggtagaatggccttttgaagactcagttactcagctaggaggcaagaccttgcagggctggggcaaggttctccagaaggccataaaggccatatatgctctgaatcagcatccaatatgtggtgctatttctcgcataaccagaattcatgggtccaggaatcattggatagaaatgggactgttacgactcataattacccccagtgacccactagcaaagtttgcttcctgttcctgcaaatttatgtgctgctagctagaggtcttagtttcagaaggaggaatgcttctatcaggagacacaacagtgattccgttgaactggaagttaagacctagccactttgagctccttatgcatctgattcaatcatccaagaagggcattacagtgttgactggggtgactgatcctgactaccaaggggaaattgggttactactccacaatgaaggtaaggaagagtatgtgtggaataaggagatcccttagggcatcccttagtattaaccatgccctgtaattaaggtcagcacaaaataacccaatccaggcaggaccactaataacccatacccttcacgaatgaaggtttcggtcaccccaccaggtaaagaatcatgaccagctgaggtgcttgctgagggaaaagggaatacagaatgagtagtaaaagaaggtaattacaaataccagctatgaccatatgaccagttatagaaataaggactataattgtcatgagtattttcttatgaatgcatttatatgtatatatacatatattaagcatatatcttcattttctttttcttattcccttatataacataagaggtattaacttatcttcattttctttttcttattcccttatataacataagaggtattaactttatattagtatttaagtatttattttatatcatagtatttaagttataggctatcaggataagagtaaacattactcaaaaactttactttcacttctggggaatgtgttagtgtgcttttagttgtatgcaggatagttgtagcctgtttggtagaattatggccttatggagattaaatatggttaaaggagatgcttatgggtaccagggtgacaaggggcagaatttgtaatggttaattttatgtgtcagcttgactaggctaagggatgcccagatagctggtaaaacactattttggggtgcgtctgtgagagtgttcctggaagagattagattagcatttgaattggtagactgattaaagaagattgcccttaccattgttggcagggatcagtcaatccattgaggacctcaaagagaagaacaaaacattgggggaagggcaatttgctttctcggagcctggacatacatattctcctgcctctaacatcagggttcctggttgattctctggcctttggacttgctttcctggttcacctttgcagacatgggacttcttggactccataattgcctgagccaattcctataataaataaatgtgtctttttctcacatacacacacacactcatacatatgtctattctatttctctggagaaccatgattaatacagagagagaaaagattagcacagatgaagtacatgttctcagttatgtggtagtacctgcccacccttccccccatttcattagcactcagaagagagggacacaaaagtggtcttcctgccttcagtagtagcatatgttgggcataatttaatttattcttgatgatccagggtagttgtaacaaatgagcacaattgatctatatataataaaatgatggctttgagtttgtaaaggtatgcatggcctctcaataaaaaataaatacttacaaagttgtctttataaatgtgtgccaggcactgagtggactgtgttgatttcctggttcatgtttagtgttcactgctcaggttttcacctctataaggtacttgtaatcatagtcagtataaggtgagggctctagaaactgcctggttttaagtgctggccccagcacttactggctaggtgatgttggcaaagttacctaccttctctgaggtacattttcttcatttgtacaggattatatgagtatgtctatgtaaatatttatgtgtataaaagatgtccccaagggacattttctatcccccagcctatcccaaggacacaaagacttacttcccacctatatggctccatgccatccatgaatggaacatagccttaaaatgtcgataacaacagtatcttcctaaaagagttatgaggattaaatgagatgattcacataaaccatttaacacaatggcacctaaatcctctaaatgttgtgccttgctgtattcctgtttgtactttgtaagtttgaaataattgaagtgcctaggggaagccagataaccaaacatattaaattaataacctttaatattttgtaggggcttaagtctctaagtaggttgggagggtttggggaggaacgattaaaagatttgtagagataaagacaaaaaaggtagaatgcgatacatgctaaatgggtggtacaaagtagtatagaagtttacaggagaaagtgggcagtttcatctggtaattaagaaagacttgatggaagaggtaacttatattgggcttgaagatgaaagggtttcaacaaaaatgttatataagctaacctctttgcccctctgtgctgtgcactgtaccatcctgacagcaactttctgatcattcctgaaccttcaaggactctacttacaagtaatggattagtgtctttgatgaaaatctgctgaggagctgcagactcctacctcccaatttaaatgtgaccatatgccttcagtcctaaagaagagtagaaagttaaataacttccttgagattcagtttcttaaatgctaacatttgttcatttaaaaatcaacagtcaccaccactttcctgtaacagcatctgagatggaagaggctatggaggcctgccagtccactaaggcatcctttcctggcttttctagccaatctggactctttaagtgtcaggagataaccactctccaagacaggccttgccagtattcttggacatctgccctacatgaaaggccctacttatatccagtagaactcagactctttgttgcaccttccatacaacagatcacccttttccttgaaggaagagctcatcatcttattcttttgcagggtcaacagccttaatttccttcaccttcagcttcatataagccaattagggtttttgtaaggctaagtcaattctgttaacactgcttgtctacatgcatatttccttccttaaacgaactctaataattatccagtatctaataattatgccttcctttcaatatatgtttgtttatttgattccactgtagaaatacaataatatgtgctaagaacctatatagttttaaatttttcatttctatatgcttacctatctgtagataaaggttcataaaggcatttatagacactataaaagttcaccagaaactgccttttaaaagataaacactattgttttatctaaagaaaacaaaaaataacaaaaaaatactgtacaaacctactccctactagtctaaacagctctgctcctgtagtttgggagcagaaatttaagtgtgcaaatttgtatttctatagttccgataaaataatagaatttctcagttgaaaatgtcttaagcctctcctctccttcctagctccattaaaatagccattgaatagtattgggtatttctttcttaaaaaaagatatatatttccaaatatattttctatgcattcgttatatattttctatgcattcgttagaaaaaagatcaaatacctgtgcttttaacctttttcttttcttttcttttctttttgaaacagagtcttgctctgttgcctagtttggagtgcagtggcacgatataatggctcactgcagccttgaactcctgggctcaagcaatcctcctacctcagcatcccaagtagctgggactacaggcacgccctaccatccccagataattttttattatttgtcgagatgaggtctccctatgttgaccaggctggtcttgaactcctgggcttaagcaatcctcctgcctcggatttgcttttagtctttacagtgattaagtggaaagagaataaagcatcaaaagttttttaatgattatcttgtagctctgggtctgctatttacaagaagtaggagagaggcagaatctctccctgcctaaaattcacaggtctagggcagtagggagagagtggcagaatcttcaccagagggtatacagacagccaaacacaacatcactgtgaagctgtgagcaagcaggcaggaagagcaatatccctgtacagtatacaatgactgccacgatacttggaaaagaaaatggaaaacaatgaataaagcttggactttcagagctatacatgagcaaatgagcaaatctaaacttgttcatatgattccttattgttcttgtaccctctttgagtacaaacaatcctgtaacacaggatcctcactttatatagtgcagggtaggtaattcacagttatcaggaatacaaaaccttatgctctggatgtgttatagatactaagaataatgtcatattctgctgagctcatggcaactctagaggagaggttaaagatccaattctttcactttagagaaagctgagacctacagagtgaaatgacctgccacatgttagtagcattagaattcactccccaagattcattccagtgttgttcctgctcttatgttatctgatttattctctcctggatattgtcaggtaatgataagggcagcagagaagtttaggggaaattacatcctaaatccagaattttaagaatcagataaacttctcacaaacagttttgctgatctttggccttttgtcttttttacagactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtaagtagctgataaaagccaaagaagagaactgtgatgcaagttgtttataatttagacataagaacaagatgagtattaggtaaaaggaactgcatttcaaaacatattatggccctttatgttatagaagctgcccgtgatgctggctgtgatgttctgtaataggtttttcacttctagcagtttggacttgagaataatgtcagctcaccctcatcatttattttctgggcccctccagtctggtggcgggcagagaaaaatgactaacaaaagcagattgtgtgggccacagctcaaatggattttttccccaccttttctcatcagtagacagtgccatttagacatccatgactttactcttttttctatgcatcttattcagtgattatgagacacaggaaaatctctagctttcaaaaacttataaacttgtgatgatgtcttatccatggagatgtcacccatttttcaccatgaaagtggttgtcagtgcctagcatttctgtatattacacacatttatctgggctttgggaaaacttgatagcaaaggggaaaagactctgcccccaaggagtagtaaggattttccactgtcattaaaaggcatagtgttgttttattcctttttcattcttatattctgcgtaatattttcatgtgtaaattctgttttctctgaacttaataatatactctatattttaaggtacttgcaacagatatgtcaaaacacatgaatctactggctgatttgaagactatggttgaaactaagaaagtgacaagctctggagttcttcttcttgataattattccgataggattcaggtaaagccttgtttgagtttgctctgtgtgtgtgtgtctgtgcacatgtgcacatgtctgcgtgttcagctttgataagatgtatttcttccttctcccaccttatactttcagcaattgtaggcaggatttttatccaaatttttattcctgagaattaaccaggtaaaattctactggtctttctgtttgcatctacattaattaaaaaaactaacaaacaaacaccccacagaaccagccacttaagcagctctgaatctagtcagccatgcacataaacagtttctcttaagctatttagatgcagtagaagtggcataatttggaactattaatacaagtgtgaactatacacagacacatcatggttgagctgtttggaataaatcttacactacgtgtatttttaagtgttgcagtcatccaatgtgaatttctagttttttttgtttttttttttaaaaaaaaggaacaggagtgaatagagaatgcatccatctattttaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtaatgcatgaagtgtatagctttcagagagaacagagctaccgctttagcatttggttactttgtattacatatgatagtattttactggatttttaaaattactttgtttttgacaagctcaatttcaccttagtatttatgatccaaagaactttcattcttatgacttacattcatatagtcatatatatattctaaagacatattcatttattatgactatattcatttaatatattcatatacatagagcacatggcattatttcagttatctggattcacctacaaattggtgattgtaaaataagccctaccatgtcaacaactggaaaattttttatgctatagaacatgctctttaaccaaaggttctagaagctaattttgaccagctagtagcaatactttactttaaatggtctgttgttgttgaaaatagtgacaattttaccaaactaagtttagtagtcttctgttcagtgttttatttgtgggccatgatctaattaagcttttccattgtttcttagtcccaagtcctctactcatactggatttttttcttaactaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaactttgtttgttttttgtttttgagcttactaagatcctggataaagagtttagagtttcctatctctttgctaactaaaaactctgtttgcttattcctcacaaattctacttttttctaaatgacaatccatttgtcatgataatgagagtaaagaaatcagcacaaatttaatccccagatcatccccagaccatgccagcagaataagggtaattaaacagagcatctatgcttagcctctccaccatttctcctgccacaacagtcctgacagccaacaggtgccaaatttgtgccttcctgggaataactgttttaaactcaagctcccttccccaaagccatgaccccaaagtgacactatggaactaaggaagcaactcccttcttttcctgacttgccacgcttgctgatttaggctaatttgggtggtggtgggcctgaactcacattaaaatctctgacctggaaacctttcctcaggcacacggctttggacccacaacagcaacattccaccaaaaaacaaaccaaaaccaaaaacattccctgttgctagagagtaccacctgtctaccaaggggaaaac

SEQ ID NO: 7 - DNA, 20 bp, Artificial Sequence
  Primer Sequence
gcagcatgagaagtccaaga

SEQ ID NO: 8 - DNA, 20 bp, Artificial Sequence
  Primer sequence
tgtatgtgccaccgtgaaac

SEQ ID NO: 9 - DNA, 36 bp, Artificial Sequence
  Probe Sequence
tcggtttctcccaagctctctccagtgataaaccga

SEQ ID NO: 10 - DNA, 22 bp, Artificial Sequence
  Primer sequence
cggaatggaaccctatcttgtc

SEQ ID NO: 11 - DNA, 23 bp, Artificial Sequence
  Primer sequence
ttggtcgttgaatgttctctgat

SEQ ID NO: 12 - DNA, 34 bp, Artificial Sequence
  Probe sequence
cctctcgccttcagacagttggaacaaggagagg

The invention claimed is:

1. A method for monitoring or prognosticating malignant, hormone-sensitive prostate cancer or the progression towards malignant, hormone-sensitive prostate cancer, comprising:
    (a) detecting the level of PDE4D7 in a prostate tissue sample;
    (b) detecting the level of expression of a reference gene in the sample, wherein the reference gene is a PDE4D5 gene;
    (c) normalizing the measured expression level of PDE4D7 to the expression of the reference gene; and
    (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 to +2.

2. A method for monitoring or prognosticating malignant, hormone-sensitive prostate cancer or the progression towards malignant, hormone-sensitive prostate cancer by discriminating between a benign prostate tumor and a malignant, hormone-sensitive prostate cancer, comprising:
    (a) detecting the level of PDE4D7 in a prostate tissue sample;
    (b) detecting the level of expression of a reference gene in the sample, wherein the reference gene is a PDE4D5 gene;
    (c) normalizing the measured expression level of PDE4D7 to the expression of the reference gene; and
    (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 and +2.

3. An immunoassay for detecting, monitoring or prognosticating malignant, hormone-sensitive prostate cancer or the progression towards malignant, hormone-sensitive prostate cancer, comprising at least the steps:
    (a) testing in a prostate tissue sample obtained from an individual for the level of expression of PDE4D7,
    (b) testing in a control sample for the level of expression of PDE4D7 and in the prostate tissue sample for the level of expression of a reference gene, wherein the control sample is selected from the group consisting of stromal prostate tissue, bladder epithelial tissue and urethra epithelial tissue and the reference gene is PDE4D5;
    (c) determining the difference in the level of expression of PDE4D7 in step(a) and the level of expression of PDE4D7 and the level of expression of PDE4D5 in step (b) by normalizing the level of expression of PDE4D7 in step (a) and step (b) to the level of expression of PDE4D5 and comparing the normalized expression levels; and
    (d) deciding on the presence or stage of cancer or the progression of cancer based on the results obtained in step (c) by comparing the normalized expression levels with a predetermined cutoff value chosen to exclude benign prostate tumor, wherein a normalized expression level above the cutoff value is indicative of a malignant, hormone-sensitive prostate cancer, wherein said cutoff value is between about −2 to +2,
    wherein said testing steps are based on the use of an antibody specifically binding to PDE4D7.

4. An immunoassay for discriminating between a benign prostate tumor and a malignant, hormone-sensitive prostate cancer, comprising:
  (a) detecting the level of PDE4D7 in a prostate tissue sample;
  (b) detecting the level of expression of a reference gene in the sample, wherein the reference gene is PDE4D5;
  (c) normalizing the measured expression level of PDE4D7 to the expression of the reference gene; and
  (d) comparing the normalized expression level with a predetermined cutoff value chosen to exclude benign prostate tumor, wherein a normalized expression level above the cutoff value is indicative of a malignant, hormone-sensitive prostate cancer, wherein said cutoff value is between about −2 and +2.

5. A method of identifying an individual for eligibility for malignant, hormone-sensitive prostate cancer therapy, comprising:
  (a) testing in a prostate tissue sample obtained from an individual for the expression of PDE4D7;
  (b) testing in said sample for the expression of a reference gene and in a control sample for the expression of PDE4D7 wherein the control sample is selected from the group consisting of stromal prostate tissue, bladder epithelial tissue and urethra epithelial tissue and the reference gene is PDE4D5;
  (c) classifying the levels of expression of step (a) relative to levels in step (b); and
  (d) identifying the individual as eligible to receive a malignant, hormone-sensitive prostate cancer therapy where the individual's sample is classified as having an increased level of PDE4D7 expression.

6. An immunoassay for stratifying an individual or cohort of individuals with a malignant, hormone-sensitive prostate cancer disease comprising:
  (a) testing in a sample obtained from an individual for the level of expression of PDE4D7;
  (b) testing in said sample for the level of expression of a reference gene and in a control sample for the level of expression of PDE4D7, wherein the control sample is selected from the group consisting of stromal prostate tissue, bladder epithelial tissue and urethra epithelial tissue and the reference gene is PDE4D5;
  (c) determining the difference in the level of expression of PDE4D7 in step(a) and the level of expression of PDE4D7 and the level of expression of PDE4D5 in step (b) by normalizing the level of expression of PDE4D7 in step (a) and step (b) to the level of expression of PDE4D5 and comparing the normalized expression levels; and
  (d) stratifying an individual or cohort of individuals to a malignant, hormone-sensitive prostate cancer therapy based on the results obtained in step (c), where the individual's sample has an increased level of PDE4D7 expression.

7. The method of claim 2, further including:
  determining the level of prostate specific antigen (PSA).

8. The method or immunoassay of claim 7, wherein a PSA level of 2.5 to 4 ng/ml is indicative of a malignant, hormone-sensitive prostate cancer.

9. The method of claim 2, wherein said cutoff value is between about −1 and +1.

* * * * *